US007388073B2

(12) United States Patent
Goddard et al.

(10) Patent No.: US 7,388,073 B2
(45) Date of Patent: Jun. 17, 2008

(54) PRO9835 POLYPEPTIDES

(75) Inventors: Audrey Goddard, San Francisco, CA (US); Paul J. Godowski, Hillsborough, CA (US); Austin L. Gurney, Belmont, CA (US); Victoria Smith, Burlingame, CA (US); Colin K. Watanabe, Moraga, CA (US); William I. Wood, Hillsborough, CA (US)

(73) Assignee: Genentech, Inc., South San Francisco, CA (US)

( * ) Notice: Subject to any disclaimer, the term of this patent is extended or adjusted under 35 U.S.C. 154(b) by 532 days.

(21) Appl. No.: 10/194,462

(22) Filed: Jul. 12, 2002

(65) Prior Publication Data

US 2003/0040076 A1 Feb. 27, 2003

Related U.S. Application Data

(63) Continuation of application No. 10/052,586, filed on Jan. 15, 2002, now abandoned, which is a continuation of application No. PCT/US01/06520, filed on Feb. 28, 2001.

(60) Provisional application No. 60/232,887, filed on Sep. 15, 2000.

(51) Int. Cl.
*C07K 14/705* (2006.01)

(52) U.S. Cl. ........................................ 530/350; 530/403

(58) Field of Classification Search ................. 530/350; 930/10

See application file for complete search history.

(56) References Cited

U.S. PATENT DOCUMENTS 5,536,637 A 7/1996 Jacobs

OTHER PUBLICATIONS

Pennica et al., Proc. Natl. Acad. Sci., USA 95:14717-14722 (1998).*

Konopka et al., Proc. Natl. Acad., Sci., USA 83:4049-4052 (1986).*

Haynes et al., Electrophoresis 19: 1862-1871 (1998).*

Hu et al., J. of Proteome Research 2:405-412 (2003).*

Chen et al., Molecular and Cellular Proteomics 1: 304-313 (2002).*

Klein et al. Selection for Genes Encoding Secreted Proteins and Receptors *Proc. Natl Acad. Sci.*, 93 7108-7113 (1996).

Orntoft et al., *Genome-wide Study of Gene Copy Numbers, Transcripts, and Protein Levels in Pairs of Non-invasive and Invasive Human Transitional Cell Carcinomas*, Mol. and Cell. Proteomics, 1.1:37-45 (2002).

Abe, N., et al., "An Increased High-Mobility Group A2 Expression Level is Associated with malignant Phenotype in Pancreatic Exocrine Tissue," *Br J Cancer—89*(11):2104-9 (2003) Abstract.

Ando, M., et al., "Selective Apoptosis of Natural Killer-Cell Tumours by I-Asparaginase," *Br J Haematol.*,—130(6):860-8 (2005) Abstract.

Aust, G., et al., "Human Thyroid Carcinoma Cell Lines and Normal Thyrocytes: Expression and Regulation of Matrix Metalloproteinase Inhibitor-1 Messenger-RNA and Protein," *Thyroid—7*(5):713-24 (1997) Abstract.

Barnes, V.L., et al., "Expression of Embryonic Fibronection Isoform EIIIA Parallels Alpha-Smooth Muscle Actin in Maturing and Diseased Kidney," *J Histochem Cytochem.—47*(6):787-98 (1999) Abstract.

Bea, S., et al., "BMI-1 Gene Amplification and Oxerexpression in Hematological Malignancies Occur Mainly in Mantle Cell Lymphonas," *Cancer Res.—61*(6):2409-12 (2001) Abstract.

Blaschke, V., et al., "Rapid Quantitation of Proinflammatory and Chemoattractant Cytokine Expression in Small Tissue Samples and Monocyte-Derived Dendritic Cells: Validation of a New Real-Time RT-PCR Technology," *J Immunol Methods,—246*(1-2):79-90 (2000) Abstract.

Buckley, A.R., et al., "Butyrate-Induced Reversal of Dexamethasone Resistance in Autonomouse Rat Nb2 Lymphoma Cells," *Apoptosis.— 2*(6):518-28 (1997) Abstract.

Caberlotto, L. et al.,"Alterations in Neuropeptide Y Levels and Y1 Binding Sites in the Flinders Sensitive Line Rats, A Genetic Animal Model of Depression," *Neurosci Lett.—265*(3):191-4 (1999) Abstracts.

Caberlotto, L., et al., "Neurokinin 1 Receptor and Relative Abundance of the Short and Long Isoforms in the Human Brain," *Eur J Neurosci.—17*(9):1736-46 (2003) Abstract.

Choi, D., et al., "Characterization of Cyclin D2 Expression in Human Endometrium," *J Soc Gynecol Investig.—9*(1):41-6 (2002) Abstract.

Couvelard, A., et al., "Human Chorionic Conadotrophin Beta Expression in Malignant Barrett's Oesophagus," *Virchows Arch.—445*(3):279-84 (2004) Abstract.

Dagenais, A., et al., "Downregulation of EnaC Activity and Expression by TNF-Alpha in Alveolar Epithelial Cells," *Am J. Physio Lung Cell Mol Physiol. 286*(2):L301-11 (2004) Abstract.

De Boer, C.J., et al., "Involement of the CCNDI Gene in Hairy Cell Leukemia," *Ann Oncol.—7*(3):251-6 (1996) Abstract.

Debieve, F., et al., "Inhibin and Activin Production and Subunit Expression in Human Placental Cells Cultured in Virtro," *Mol Hum Reprod.—6*(8):743-9 (2000) Abstract.

Dong, Z., et al., "Expression of Membrane-Type Matrix Metalloproteinases 4, 5, and 6 in Mouse Corneas Infected with *P. Aeruginosa," Invest Opthalmol Vis Sci—42*(13):3223- (2001) Abstract.

Duchrow, M., et al., "Assessment of Proliferative Activity in Colorectal Carcinomas by Quantitative Reverse Transcriptase-Polymerase Chain Reaction (RT-PCR)," *Cancer Invest.—19*(6):588-96 (2001) Abstract.

(Continued)

*Primary Examiner*—Robert C. Hayes
(74) *Attorney, Agent, or Firm*—Elizabeth M. Barnes; Mark T. Kresnak; Ginger R. Dreger

(57) ABSTRACT

The present invention is directed to novel polypeptides and to nucleic acid molecules encoding those polypeptides. Also provided herein are vectors and host cells comprising those nucleic acid sequences, chimeric polypeptide molecules comprising the polypeptides of the present invention fused to heterologous polypeptide sequences, antibodies which bind to the polypeptides of the present invention and to methods for producing the polypeptides of the present invention.

6 Claims, 615 Drawing Sheets

OTHER PUBLICATIONS

Dyer, J., et al., "Molecular Characterisation of Carbohydrate Digestion and Absorption in Equine Small Intestine," *Equine Vet J.—34*(4):349-58 (2002) Abstract.
Egwuagu, C.E., et al., "Suppressors of Cytokine Signaling Proteins are Differentially Expressed in Th1 and Th2 Cells Implications for Th Cell Lineage Commitment and Maintenance," *J. Immunol.—168*(7):3181-7 (2002) Abstract.
El-Ghrably, I.A., et al., "Intravitral Invading Cells Contribute to Vitreal Cytokine Milieu in Proliferative Vitreoretinopathy," *Br J Opthalmol.—85*(4):461-70 (2001) Abstract.
Eleore, L., et al., "Modulation of the Glutamatergic Receptors (AMPA and NMDA) and of Glutamate Vesicular Transporter 2 in the Rat Facial Nucleus after Axotomy," *Neuroscience—136*(1):147-60 (2005) Abstract.
Forsberg, H., et al., "Altered Levels of Scavenging Enzymes in Embryos Subjected to a Diabetic Environment," *Free Radic Res.—24*(6):451-9 (1996) Abstract.
Freyschuss, B., et al., "Induction of the Estrogen Receptor by Growth Hormone and Glucocorticoid Substitution in Priminary Cultures of Rat Hepatocytes," *Endocrinology—133*(4):1548-54 (1993) Abstract.
Fuchs, A. R., et al., "Oxytocin Receptors in Bovine Cervix: Distrubution and Gene Expression During the Estrous Cycle," *Biol Reprod.—54*(3):700-8 (1996) Abstract.
Furuta, J., et al., "Silencing of the Thrombomodulin Gene in Human Malignant Melanoma," *Melanoma Res.—15*(1):15-20 (2005) Abstract.
George, J. et al., "Pre-translation Regulation of Cytochrome P450 Genes is Responsible for Disase-Specific Changes of individual P450 Enzymes Among Patients with Cirrhosis," *Biochem Pharmacol.*—49(7):873-81 (1995) Abstract.
Giroux, M., et al., " Cyclooxygenase-2 Expression in Macrophages: Modulation by Protein Kinase C-alpha," *J immunol.*—165(7):3985-91 (2000) Abstract.
Godbout, R., et al., "Overexpression of DEAD Box Protein (DDX1) in Neuroblastoma and Retinoblastoma Cell Lines," *J Biol Chem,*—273(33):21161-8 (1998) Abstract.
Goldenberg, R.C. et al., "Modulation of Gap Junction Mediated Intercellular Communication in TM3 Leydig Cells," *J Endocrinol.—177*(2):327-35 (2003) Abstract.
Golebiowski, F., et al., "Expression Level of Ubc9 Protein in Rat Tissues," *Acta Biochim Pol.—50*(4):1065-73 (2003) Abstract.
Grem, J.L., et al., "Thymidine Kinase, Thymidylate Synthase, and Dihydropyrimidine Dehydrogenase Profiles of Cell Lines of the National Cancer Institute's Anticancer Drug Screen," *Clin Cancer Res.—7*(4):999-1009 (2001) Abstract.
Grenback, E., et al., "Galanin Pituitary Adenomas," *Regul Pept,*—117(2):127-39 (2004) Abstract.
Gromova, I., et al., "Protein Abundance and mRNA Levels of the Adipocyte-Type Fatty Acid Binding Protein Correlate in Non-Invasive and Invasive Bladder Transitional Cell Carcinomas," *Int J. Oncol.—13*(2):379-83 (1998) Abstract.
Guo, Y., et al., "The Pathogenic Role of Macrophage Migration Inhibitory Factor in Acute Respiratory Distres Syndrome," Zhinghua Jie He He Hu Xi Za Zhi—25(6):337-40 (2002) Abstract.
Habu, Y., et al., "Restored Expression and Activity of Organix Ion Transporters rOAT1, rOAT3 and rOCT2 after Hyperuricemia in the Rat Kidney," *Biochem Pharmacol—69*(6):993-9 (2005) Abstract.
Hahn, M.E., et al., "Regulation of Cytochrome P4501A1 In Teleosts: Sustained Induction of CYP1a1 mRNA, Protein, and Catalytic Activity by 2,3,7,8-Tetrachlorodibenzofuran in the Marine Fish Stenotomus Chrysops," *Toxicol Appl Pharmacol.—127*(2):187-98 (1994) Abstract.
Hamilton, L.M., et al., "The role of the Epidermal Growth Factor Receptor in Sustaining Neutrophil Inflammation in Severe Asthma," *Clin Exp Allergy.—33*(2):233-40 (2003) Abstract.
Hassett, C., et al., "Human Hepatic Microsomal Epoxide Hydrolase: Comparative Analysis of Polymorphic Expression," *Arch Biochem Biophys.*337(2):275-83 (1997) Abstract.
Holten-Andersen, M.N., et al., "Localization of Tissue Inhibitor of Metalloproteinases 1 (TIMP-1) in Human Colorectal Adenoma and Adenocarcinoma," *Int J Cance*, —113(2):198-206 (2005) Abstract.
Huang, Y.H., et al., "Tissue Plasminogen Activator Induced by Dengue Virus Infection of Human Endothelial Cells," *J Med Virol.—70*(4):610-6 (2003) Abstract.
Huettner, P.C., et al., "Neu Oncogene Expression in Ovarian Tumors: A Quantitative Study," *Mod Pathol.—5*(3):250-6 (1992) Abstract.
Hui, P., et al., "Real-time Quantitative RT-PCR of Cyclin D1 mRNA in Mantle Cell Lymphoma: Comparison with FISH and Immunohistochemistry," Leuk Lymphoma. 44(8):1385-94 (2003) Abstract.
Husain, I., et al., "Elevation of Topoisomerase I Messenger RNA, Protein, and Catalytic Activity in Human Tumors: Demonstration of Tumor-Type Specificity and Implications for Cancer Chemotherapy," *Cancer Res.—54*(2):539-46 (1994) Abstract.
Ihmann, T., et al., "High-level mRNA Quantification of Proliferation Marker pKi-67 is Correlated with Favorable Prognosis in Colorectal Carcinoma," *J Cancer Res Clin Oncol.—130*(12):749-56 (2004) Abstract.
Ikegami, T., et al., "Modulation of Glucgon Receptor Expression and Response in Transfected Human Embryonic Kidney Cells," *Am J Physiol Cell Physiol.—281*(4):C1396-402 (2001) Abstract.
Jacquemin, E., et al., "Developmental Regulation of Acidic Fibroblast Growth Factor (aFGF) Expression in Bovine Retina," *Int J Biol.—37*(3):417-23 (1993) Abstract.
Jaime, M., et al., "The p21 (Cip1) Protein, A Cyclin Inhibitor, Regulates the Levels and the Intracellular Localization of CDC25A in Mice Regenerating Livers," *Hepatology—35*(5):1063-71 (2002) Abstract.
Jungbluth, A.A., et al., "Immunohistochemical Analysis of NY-ESO-1 Antigen Expression in Normal and Malignant Human Tissues," *Int J. Cancer—92*(6):856-60 (2001) Abstract.
Kammaori, M., et al., "Expression of Human Telomerase Reverse Transcriptase Gene and Protein, and of Estrogen amd Progesterone Receptors, in Breast Tumors: Preliminary Data from Neo-Ajuvant Chemotherapy," *Int J Oncol.—27*(5):1257-63 (2005) Abstract.
Khal, J., et al., "Expression of the Ubiquitin-Proteasome Pathway and Muscle Loss in Experimental Cancer Cachexi," *Br J Cancer—93*(7):774-80 (2005), Abstract.
Khal, J., et al., "Increased Expression of Proteasome Subunits in Skeletal Muscle of Cancer Patients with Weight Loss," Int *J. Biochem Cell Biol.—37*(10):2196-206 (2005) Abstract.
Kogo, H., et al., "Cell Type-Specific Occurrence of Caveolin-1alpha and -1beta in the Lung Caused by Expression of Distinct mRNAs," *J Biol Chem.—279*(24):25574-81 (2004) Abstract.
Kommoss, F., et al., "Oncogene and Growth Factor Expression in Ovarian Cancer," *Acta Obstet Gynecol Scand Suppl.—155*:19-24 (1992) Abstract.
Kumar, U., et al., "Somatostatin Receptors in Primary Human Breast Cancer: Quantitative Anaylsis of mRNA for Subtypes 1-5 and Correlation with Receptor Protein Expression and Tumor Pathology," *Breast Cancer Res. Treat.—92*(2):175-86 (2005) Abstract.
Landmark, B.F., et al., "Cellular Location and Age-dependent Changes of the regulatory Subunits of cAMP-dependent Protein Kinase in Rat Testis," *J Reprod Fertil.—99*(2):323-34 (1993) Abstract.
Lassmann, S., et al., "Quantification of CK20 Gene and Protein Expression in Colorectal Cancer by RT-PCR and Immunohistochemistry Reveals Inter- and Intratumour Heterogeneity," *J. Pathol.—198*(2):198-206 (2002) Abstract.
Legrand, O., et al., "Expression of the Multidrug Resistance-Associated Protein (MRP) mRNA and Protein in the Normal Peripheral Blood and Bone Marrow Haemopoietic Cells," *Br J, Haematol.—94*(1):23-33 (1996) Abstract.
Lemstrom, K.B., et al., "Vascular Endothelial Growth Factor Enhances Cardiac Allograft Arteriosclerosis," *Circulation—105*(21):2524-30 (2002) Abstract.
Li, Z.B., et al., "Enhanced Expressions of Arachidonic Acid-Sensitive Tandem-Pore Domain Potassium Channels in Rat Experimental Acute Cerebral Ischemia," *Biochem Biophys Res Commun.—327*(4):1163-9 (2005) Abstract.
Li, Y., et al., "Retinal Preconditioning and the Induction of Heat-Shock Protein 27," *Invest Ophthalmol Vis Sci.—44*(3):1299-304 (2003) Abstract.

Lindberg, P., et al., "Increasing Expression of Tissue Plasmingogen Activator and Plasminogen Activator Inhibitor Type 2 in Dog Gingival Tissues with Progressive Inflammation," *Arch Oral Biol.—46*(1):23-31 (2001) Abstract.

Macabeo-Ong, M., et al., "Effect of Duration of Fixation on Quantitative Reverse Transcription Polymerase Chain Reaction Analyses," 15(9):979-87 (2002) Abstract.

Meehan, T.P., et al., "Tightly Regulated and Inducible Expression of a Yoked-Hormone-Receptor Complex in HEK 293 Cells," *J Mol Endocrinol.—32*(1):247-55 (2004) Abstract.

Mendoza-Rodriguez, C.A., et al., "C-fos and Estrogen Receptor Gene Expression Pattern in the Rat Uterine Ephithelium During the Estrous Cycle," *Mol Reprod Dev.—64*(4):379-88 (2003) Abstract.

Meoni, P., et al., "[3H]MK-801 Binding and the mRNA for the NMDARI Subunit of the NMDA Receptor are Differentially Distbributed in Human and Rat Forebrain,"*Brain Res Mol Res.—54*(1):13-23 (1998) Abstract.

Mezzano, S.A., et al., "OVerexpression of Chemokines, Fibrogenic Cytokines, and Myofibroblasts in Human Membranous Nephropathy," *Kiney Int.—57*(1):147-58 (2000) Abstract.

Mingrone, G., et al., "Decreased Uncoupling Protein Expression and Intramyocytic Triglyceride Depletion in Formerly Obese Subjects," *Obes Res.—11*(5):632-40 (2003) Abstract.

Miralles, C.P., et al., "Differential Expression of the Short and Long Forms of the Gamma 2 Subunit of the GABAA/benzodiazepine Receptors," *Brain Res Mol Res.—24*(1-4):129-39 (1994) Abstract.

Mizrachi, D., et al., "Follicle-Stimulating Hormone Receptor and Its Messenger Ribonucleic Acid are Present in the Bovine Cervix and Can Regulate Cervical Prostanoid Synthesis," *Biol Reprod.—61*(3):776-84 (1999) Abstract.

Monaghan, P., et al., "The Alpha(v)beta6 Integrin Receptor for Foot-and-Mouth Disease Virus is Expressed Constitutively on the Epithelial Cells Targeted in Cattle," *J Gen Virol.—86*(Pt 10):2769-80 (2005) Abstract.

Montuori, N., et al., "Urokinase-Mediated Posttranscriptional Regualtion of Urokinase-Receptor Expression in Non Small Cell Lung Carcinoma," *Int J Cancer—105*(3):353-60 (2003) Abstract.

Munaut, C.,et al., "Vascular Endothelial Growth Factor Expression Correlates with Matrix Metalloproteinases MT1-MMP, MMP-2 and MMP-9 in Human Glioblastomas," *Int J Cancer—106*(6):848-55 (2003) Abstract.

Nie, Y., et al., "DNA Hypermethylation is a Mechanism for Loss of Expression of the HLA Class I Genes in Human Esophageal Squamous Cell Carcinomas," *Carcinogenesis—22*(10):1615-23 (2001) Abstract.

Nuciforo, P.G., et al., "Molecular and Immunohistochemical Analysis of HER2/neu Oncogene in Synovial Sarcoma," *Hum Pathol.—34*(7):639-45 (2003) Abstract.

Oberringer, M., et al., "Differential Expression of Heat Shock Protein 70 in Well Healing and Chronic Human Wound Tissue," *Biochem Biophys Res Commun.—214*(3):1009-14 (1995) Abstract.

Pachmann, K., et al., "Expression of bcr-abl mRNA in Individual Chronic Myelogenous Leukaemia Cells as determined by in Situ Amplification," *Br J. Haematol—112*(3):749-59 (2001) Abstract.

Pairon, J.C., et al.., "Cell Localization and Regulation of Expression of Cytochrome P450 1A1 and 2B1 in Rat Lung after Induction with 3-Methylcholanthrene Using mRNA Hybridization and Immunohistochemistry," *Am J Respir Cell Mol Biol.—11*(4):386-96 (1994) Abstract.

Papotti, M., et al., "Expression of Somatostatin Receptor Types 1-5 in 81 Cases if Gastrointestinal and Pancreatic Endocrine Tumors. A correlative Immunohistochemical and Reverse-Transcriptase Polymerase Chain Reaction Analysis," *Vichows Arch.*—440(5):461-75 (2002) Abstract.

Paredes, J., et al., "P-Cadherin Overexpression is an Indicator of Clinical Outcome in Invasive Breast Carcinomas and is Associated with CDH3 Promoter Hypomethylation,"*Clin Cancer Res.—11*(16):5869-77 (2005) Abstract.

Politis, I., et al., "Mammary-Derived Growth Inhibitor Protein and Messanger Ribonucleic Acid Concentrations in Different Physiological States of the Gland," *J Dairy Sci.—75*(6):1423-9 (1992) Abstract.

Preesman, A.H., et al., "T-Cell Receptor V Beta-family Usage in Primary Cutaneous and Primary Nodal T-cell non-Hodgkin's Lymphomas," *J Invest Dermatol.—99*(5):587-93 (1992) Abstract.

Pullig, O., et al., "Matrilin-3 in Human Articular Cartilage: Increased Expression in Osteoarthritis," *Osteoarthritis Cartilage—10*(4):253-63 (2002) Abstract.

Rey, C., et al., "Up-regulation of Mitochondrial Peripheral Benzodiazepine Receptor Expression by Tumor Necrosis Factor Alpha in Testicular Leydig Cells. Possible Involvement in Cell Survival," *Biochem Pharmacol.—60*(11):1636-46 (2000) Abstract.

Rudlowski, C., et al., "GLUT1 Messenger RNA and Protein Induction Rrelates to the Malignant Transformation of Cervical Cancer," *Am. J. Clin Pathol.—120*(5):691-8 (2003) Abstract.

Sasaki, T., et al., "Expression and Distribution of Laminin Alpha1 and Alpha2 Chains in Embryonic and Adult Mouse Tissues: An Immunochemical Approach," *Exp Cell Res.—275*(2):189-99 (2002) Abstract.

Sedelies, K.A., et al., "Discordant Regulation of Granzyme H and Granzyme B Expression in Human Lymphocytes," *J Biol Chem.—279*(25):26581-7 (2004) Abstract.

Shen, Y., et al., "BCL2 Protein Expression Parallels its mRNA level in Normal and Maligent B Cells," *Blood—104*(9):2936-9 (2004) Abstract.

Shinohara, Y., et al., "Quantitative Determinations of the Steady Transcript Levels of Hexokinase Isozymes and Glucose Transporter Isoforms in Normal Rat Tissues and the Malignant Tumor Cell Line AH130," *Biochim Biophys Acta—1368*(1):129-36 (1998) Abstract.

Silvers, A.L., et al., "UVA Irradiation-Induced Activation of Activator Protein-1 is Correlated with Induced Expression of AP-1 Family Memebers in the Human Keratinocyte Cell Line HaCat," *Photochem Photbiol.—75*(3):302-10 (2002) Abstract.

Song, L., et al., "Rat Kidney Glutamyl Aminopeptidase (aminopeptidase A): Molecular Identity and Cellular Localization," *Am. J. Physicol.—267*(4 Pt 2):F546-57 (1994) Abstract.

Spaziani, E.P., et al., "Tumor Necrosis Factor-Alpha Upregulates the Prostaglandin E2 EP1 Receptor Subtype and the Cyclooxgenase-2 Isoform in Cultured Amnion WISH Cells," *J Interferon Cytokine Res.—8*(12):1039-44 (1998) Abstract.

Spika, I., et al., "Transcriptional Activity of Potent Glucocorticoids: Relevance of Glucocorticord Receptor Isoforms and Drug Metabolites," *Skin Pharmacol Appl Skin Physiol.*—16(3):142-50 (2003) Abstract.

Splinter, P.L., et al., "Specific Inhibition of AQP1 Water Channels in Isolated Rat Intrahepatic Bile Duct Units by Small Interfering RNAs," *J Biol Chem—278*(8):6268-74 (2003) Abstract.

Stearns, M.E., et al., "Type IV Collagenase (M(r) 72,000) Expression in Human Prostate: Benign and Malignant Tissue," *Cancer Res.—53*(4):878-83 (1993) Abstract.

Stein, R., et al., "The Decompensated Detrusor III: Impact of Bladder Outlet Obstruction on Sarcoplasmic Endoplasmic Reticulum Protein and Gene Expression," *J Urol.—164*(3Pt 2):1026-30 (2000) Abstract.

Strickland, I., et al. , "TNF-Alpha and IL-8 are Upregulated in the Epidermis of Normal Human Skin after UVB Exposure: Correlation with Nuetrophil Accumulation and E-Selectin Expression," *J Invest Dermatol.—108*(5):763-8 (1997) Abstract.

Strutz, F., et al., "Basic Fibroblast Growth Factor Expression is Increased in Human Renal Fibrogenesis and May Mediate Acutocrine Fibroblast Proliferation," *Kidney Int.—57*(4):1521-38 (2000) Abstract.

Takahashi, K., et al., "Adiposity Elevates Plasma MCP-1 Levels Leading to the Increased CD11b-Positive Monocytes in Mice," *J Biol. Chem.—278*(47):46654-60 (2003) Abstract.

Takimoto, Y., et al., "Augmented Expression of Neuronal Nitric Oxide Synthase in the Atria Parasympthetically Decreases Heart Rate During Acute Myocardial Infarction In Rats," *Circulation—105*(4):490-6 (2002) Abstract.

Telek, G., et al., "Differential Upregulation of Cellular Adhesion Molecules at the Sites of Oxidative Stress in Experimental Acute Pancreatitis," *J Surg Res.—96*(1):56-67 (2001) Abstract.

Timchenko, L., et al., "Myotonic Dystrophy: An Unstable CTG Repeat in a Protein Kinase Gene," *Semin Cell Biol.—6*(1):13-9(1995) Abstract.

Torronen, R., et al., "Induction of Class 3 Aldehyde Dehydrogenase in the Mouse Hepatoma Cell Line Hepa-1 by Various Chemicals," *Chem Biol. Interact.—83*(2):107-19 (1992) Abstract.
Ullmannova, V., et al., "Relationship Between Cyclin D1 and p21 (Waf1/Cip1) During Differentiation of Human Myeloid Leukemia Cell Lines," *Leuk Res.—27*(12):1115-23 (2003) Abstract.
Van Beers, E.H., et al., "Intestinal Carbamoyl Phosphate Synthase I in Human and Rat. Expression during Development Shows Species Differences and Mosaic Expression in Duodenum of Both Species," *J Histochem Cytochem.—46*(2):231-40 (1998) Abstract.
Van Der Wilt, C.L., et al., "Expression of Deoxycytidine Kinase in Leukaemic Cells Compared with Solid Tumour Cell Lines, Liver Metastases and Normal Liver," *Eur J Cancer—39*(5):691-7 (2003) Abstract.
Waldherr, R., et al., "Expression of Cytokines and Growth Factors in Human Glomerulonephritides," *Pediatr Nephrol.—7*(4):471-8 (1993) Abstract.
Hähnel, E., et al., "Expression of the pS2 Gene in Breast Tissues Assessed by pS2-mRNA Analysis and pS2-Protein Radioimmunoassay," *Breast Cancer Research and Treatment—24*:71-74 (1992).
Hirsch, F.R., et al., "Early Detection of Lung Cancer: Clinical Perspectives of Recent Advances in Biology and Radiology," *Clinical Cancer Research—7*:5-22 (2001).
Holten-Andersen, M.D., et al., "Localization of Tissue Inhibitor of Metalloproteinases 1 (TIMP-1) in Human Colorectal Adenoma and Adenocarcinoma," *Int. J. Cancerl—113*:198-206 (2005).
Janssens, N., et al., "Alteration of Frizzled Expression in Renal Cell Carcinoma," *Tumor Biology—25*:161-171 (2004).
Kuo, C.C., et al., "A Transcriptomic and Proteomic Analysis of the Effect of CpG-ODN on Human THP-1 Monocytic Leukemia Cells," *Proteomics—5*:894-906 (2005).
Lewin, B., Genes VI (1997 *Genes VI* at 847-848.
Meric, F., et al., "Translation Initiation in Cancer: A Novel Target for Therapy," *Molecular Cancer Therapeutics—1*: 971-979 (2002).
Munaut, C., et al., "Vascular Endothelial Growth Factor Expression Correlates With Matrix Metalloproteinases MT1-NMP, MNP-2 and NMP-9 in Human Glioblastomas,"*Int. J. Cancer—106*:848-855 (2003).
Maruyama, H., et al., "Id-1 and Id-2 are Overexpressed in Pancreatic Cancer and in Dysplastic Lesions in Chronic Pancreatitis," *American Journal of Pathology—155*(3):815-822 (1999).
Papotti, M., et al., "Correlative Immunohistochemical and Reverse Transcriptase Polymerase Chain Reaction Analysis of Somatostatin Receptor Type 2 in Neuroendocrine Tumors of the Lung," *Diagnostic Molecular Pathology—9*(1):47-57 (2000).
Walmer, D. K., et al., "Malignant Transformation of the Human Endometrium is Associates with Overexpression of Lactoferrin Messenger RNA and Protein," *Cancer Research—55*(5):1168-1174 (1995).
Wang, J., et al., "Expression of Cadherins and Catenins in Paired Tumor and non-Neoplastic Primary Prostate Cultures and Corresponding Prostatectomy Specimens," *Urol Resl—28*:308-315 (2000).
Zhigang, Z. et al., "Prostate Stem Cell Antigen (PSCA) Express in Human Prostate Cancer Tissues and its Pontential Role in Prostate Carinogenesis and Progession of Prostate Cancer," *World Journal of Surgical Oncology*—2-13 (2004).
Fu, K., et al., "Cyclin D1-Negative Mantle Cell Lymphoma: A Clinocopathologic Study Based on Gene Expression Profiling," *Blood—106*(13):4315-21 (2005) Abstract.
Kalabis, G.M., et al., "Multidrug Resistance Phosphoglycoprotein (ABCB1) in the Mouse Placenta: Fetal Protection," *Biol Reprod.—73*(4):591-7 (2005) Abstract.
Hedge, P.,et al., "A Concise Guide to cDNA Microarray Analysis," *BioTechniques—29*(3):548-562 (2000).
Quackenbush, J., "Microarry Data Normalization and Transformation," *Nature Genetics Supplement—32*:496-501.
Wang, J., et al., "Cell Proliferation in Human Soft Tissue Tumors Correlates with Platelet-derived Growth Factor B Chain Expression: An Immunohistochemical and in Situ Hybridization Study," *Cancer Res.—54*(2):560-4 (1994) Abstract.
Wang, L.G., et al., "Down-Regulation of Prostate-Specific Antigen Expression by Finasteride through Inhibition of Complex Formation Between Androgen Receptor and Steroid Receptor-binding Consensus in the Promoter if the PSA Gene in LNCaP Cells," *Cancer Res.*—57(4):714-9 (1997) Abstract.
Weterman, M.A., et al., "Expression of Calcyclin in Human Melanocytic Lesions," *Cancer Res.—53*(24):6061-6 (1993) Abstract.
Williams, E.T., et al., "Estrogen Regulation of the Cytochrome P450 3A Subfamily in Humans," J Pharmacol Exp Ther. 311(2):728-35 (2004) Abstract.
Wojtaszek, P.A., et al., "Severely Decreased MARCKS Expression Correlates with Ras Reversion but not with Mitogenic Responsiveness" *Oncogene—8*(3):755-60 (1993) Abstract.
Zhong, W, et al., "Expression of Superoxide Dismutases, Catalase, and Glutathione Peroxidase in Glioma Cells," *Free Radic Biol Med.— 27*(11-12):1334-45 (1999) Abstract.
Xi, L., et al., "Expression of Human Telomerase Transcriptase in Cervix Cancer and its Significance," Zhonghua Fu Chan Ke Za Zhi—40(6):407-10 (2005) Abstract.
Alberts, B., et al., Molecular Biology of the Cell (3rd ed. 1994) Cell 3rd at 453 Figure 9-2 of Cell 3rd Cell 3 rd at 403.
Alberts, B., et al., Molecular Biology of the Cell (4th ed.) In Cell 4th, Figure 6-3 on p. 302 Figure 6-90 on p. 364 of Cell 4th Cell 4th at 364 Cell 4th at 379.
Aust, G., et al., "Human Throid Carcinoma Cell Lines and Normal Thyrocytes: Expression and Regulation of Matrix Metalloproteinase-1 and Tissue Matrix Metalloproteinase Inhibitor- Messenger-RNA and Protein," *Thyroid—7*(5):713-724 (1997).
Beà, S., et al., "BMI-1 Gene Amplification and Overexpression in Hematological Malignancies Occur Mainly in Mantle Cell Lymphomas," *Cancer Research—61*:2409-2412 (2001).
Beer, et al., "Gene-expression profiles predict survival of patients with lung adenocarcinoma," *Nature Biomedicine—98*(6):816-824 (2002).
Futcher, B., et al., "A Sampling of the Yeast Proteome," *Molecular and Cellular Biology—19*(11):7357-7368 (1999).
Gnatenko, D.V., et al., "Transcript Profiling of Human Platelets Using Microarray and Serial Analysis of Gene Expression," *Blood—101*(6):2285-2293 (2003).
Greenbaum, D., et al., "Analysis of mRNA Expression and Protein Abundance Data: An Approach for the Comparison of the Enrichment of Features in the Cellular Population of Proteins and Transcripts," *Bioinformaticsl—18*(4):585-496 (2002).
Gromova, I., et al., "Protein Abundancy and mRNA Levels of the Adipocyte-Type Fatty Acid Binding Protein Correlate in Non-Invasive and Invasive Bladder Transitional Cell Carcinomas," *International Journal of Oncology—13*(2) 6 pages (1998).

* cited by examiner

FIGURE 1

GAAGGCTGCCTCGCTGGTCCGAATTCGGTGGCGCCACGTCCGCCCGTCTCCGCCTTCTGCATCGCGGCTTCGGCG
GCTTCCACCTAGACACCTAACAGTCGCGGAGCCGGCCGCGTCGTGAGGGGGTCGGCACGGGGAGTCGGGCGGTCT
TGTGCATCTTGGCTACCTGTGGGTCGAAGATGTCGGACATCGGAGACTGGTTCAGGAGCATCCCGGCGATCACGC
GCTATTGGTTCGCCGCCACCGTCGCCGTGCCCTTGGTCGGCAAACTCGGCCTCATCAGCCCGGCCTACCTCTTCC
TCTGGCCCGAAGCCTTCCTTTATCGCTTTCAGATTTGGAGGCCAATCACTGCCACCTTTTATTTCCCTGTGGGTC
CAGGAACTGGATTTCTTTATTTGGTCAATTTATATTTCTTATATCAGTATTCTACGCGACTTGAAACAGGAGCTT
TTGATGGGAGGCCAGCAGACTATTTATTCATGCTCCTCTTTAACTGGATTTGCATCGTGATTACTGGCTTAGCAA
TGGATATGCAGTTGCTGATGATTCCTCTGATCATGTCAGTACTTTATGTCTGGGCCCAGCTGAACAGAGACATGA
TTGTATCATTTTGGTTTGGAACACGATTTAAGGCCTGCTATTTACCCTGGGTTATCCTTGGATTCAACTATATCA
TCGGAGGCTCGGTAATCAATGAGCTTATTGGAAATCTGGTTGGACATCTTTATTTTTTCCTAATGTTCAGATACC
CAATGGACTTGGGAGGAAGAAATTTTCTATCCACACCTCAGTTTTTGTACCGCTGGCTGCCCAGTAGGAGAGGAG
GAGTATCAGGATTTGGTGTGCCCCCTGCTAGCATGAGGCGAGCTGCTGATCAGAATGGCGGAGGCGGGAGACACA
ACTGGGGCCAGGGCTTTCGACTTGGAGACCAGTGAAGGGGCGGCCTCGGGCAGCCGCTCCTCTCAAGCCACATTT
CCTCCCAGTGCTGGGTGCACTTAACAACTGCGTTCTGGCTAACACTGTTGGACCTGACCCACACTGAATGTAGTC
TTTCAGTACGAGACAAAGTTTCTTAAATCCCGAAGAAAAATATAAGTGTTCCACAAGTTTCACGATTCTCATTCA
AGTCCTTACTGCTGTGAAGAACAAATACCAACTGTGCAAATTGCAAAACTGACTACATTTTTTGGTGTCTTCTCT
TCTCCCCTTTCCGTCTGAATAATGGGTTTTAGCGGGTCCTAATCTGCTGGCATTGAGCTGGGGCTGGGTCACCAA
ACCCTTCCCAAAAGGACCTTATCTCTTTCTTGCACACATGCCTCTCTCCCACTTTTCCCAACCCCCACATTTGCA
ACTAGAAAAAGTTGCCCATAAAATTGCTCTGCCCTTGACAGGTTCTGTTATTTATTGACTTTTGCCAAGGCTGGT
CACAACAATCATATTCACGTTATTTTCCCCTTTTGGTGGCAGAACTGTTACCAATAGGGGGAGAAGACAGCCACG
GATGAAGCGTTTCTCAGCTTTTGGAATTGCTTCGACTGACATCCGTTGTTAACCGTTTGCCACTCTTCAGATATT
TTTTATAAAAAAAGTACCACTGAGTTCATGAGGGCCACAGATTGGTTATTAATGAGATACGAGGGTTGGTGCTGG
GTGTTTGTTTCCTGAGCTAAGTGATCAAGACTGTAGTGGAGTTGCAGCTAACATGGGTTAGGTTTAAACCATGGG
GGATGCACCCCTTTGCGTTTCATATGTAGCCCTACTGGCTTTGTGTAGCTGGAGTAGTTGGGTTGCTTTGTGTTA
GGAGGATCCAGATCATGTTGGCTACAGGGAGATGCTCTCTTTGAGAGGTCCTGGGCATTGATTCCCATTTCAATC
TCATTCTGGATATGTGTTCATTGAGTAAAGGAGGAGAGACCCTCATACGCTATTTAAATGTCACTTTTTTGCCTA
TCCCCCGTTTTTTGGTCATGTTTCAATTAATTGTGAGGAAGGCGCAGCTCCTCTCTGCACGTAGATCATTTTTTA
AAGCTAATGTAAGCACATCTAAGGGAATAACATGATTTAAGGTTGAAATGGCTTTAGAATCATTTGGGTTTGAGG
GTGTGTTATTTTGAGTCATGAATGTACAAGCTCTGTGAATCAGACCAGCTTAAATACCCACACCTTTTTTTCGTA
GGTGGGCTTTTCCTATCAGAGCTTGGCTCATAACCAAATAAAGTTTTTTGAAGGCCATGGCTTTTCACACAGTTA
TTTTATTTTATGACGTTATCTGAAAGCAGACTGTTAGGAGCAGTATTGAGTGGCTGTCACACTTTGAGGCAACTA
AAAAGGCTTCAAACGTTTTGATCAGTTTCTTTTCAGGAAACATTGTGCTCTAACAGTATGACTATTCTTTCCCCC
ACTCTTAAACAGTGTGATGTGTGTTATCCTAGGAAATGAGAGTTGGCAAACAACTTCTCATTTTGAATAGAGTTT
GTGTGTACTTCTCCATATTTAATTTATATGATAAAATAGGTGGGGAGAGTCTGAACCTTAACTGTCATGTTTTGT
TGTTCATCTGTGGCCACAATAAAGTTTACTTGTAAAATTTTAGAGGCCATTACTCCAATTATGTTGCACGTACAC
TCATTGTACAGGCGTGGAGACTCATTGTATGTATAAGAATATTTCTGACAGTGAGTGACCCGGAGTCTCTGGTGT
ACCCTCTTACCAGTCAGCTGCCTGCGAGCAGTCATTTTTTCCTAAAGGTTTACAAGTATTTAGAACTTTTCAGTT
CAGGGCAAAATGTTCATGAAGTTATTCCTCTTAAACATGGTTAGGAAGCTGATGACGTTATTGATTTTGTCTGGA
TTATGTTTCTGGAATAATTTTACCAAAACAAGCTATTTGAGTTTTGACTTGACAAGGCAAAACATGACAGTGGAT
TCTCTTTACAATGGAAAAAAAAAATCCTTATTTTGTATAAAGGACTTCCCTTTTTGTAAACTAATCCTTTTTAT
TGGTAAAAATTGTAAATTAAAATGTGCAACTTG

FIGURE 2

MSDIGDWFRSIPAITRYWFAATVAVPLVGKLGLISPAYLFLWPEAFLYRFQIWRPITATFYFPVGPGTGFLYLVN
LYFLYQYSTRLETGAFDGRPADYLFMLLFNWICIVITGLAMDMQLLMIPLIMSVLYVWAQLNRDMIVSFWFGTRF
KACYLPWVILGFNYIIGGSVINELIGNLVGHLYFFLMFRYPMDLGGRNFLSTPQFLYRWLPSRRGGVSGFGVPPA
SMRRAADQNGGGGRHNWGQGFRLGDQ

Transmembrane domain:
amino acids 98-116, 152-172

N-myristoylation site.
amino acids 89-95, 168-174, 176-182, 215-221, 221-227, 237-243

Glycosaminoglycan attachment site.
amino acids 218-222

FIGURE 3

GAGCGAGGCCGGGGACTGAAGGTGTGGGTGTCGAGCCCTCTGGCAGAGGGTTAACCTGGGTCAAATGCACGGATT
CTCACCTCGTACAGTTACGCTCTCCCGCGGCACGTCCGCGAGGACTTGAAGTCCTGAGCGCTCAAGTTTGTCCGT
AGGTCGAGAGAAGGCCATGGAGGTGCCGCCACCGGCACCGCGGAGCTTTCTCTGTAGAGCATTGTGCCTATTTCC
CCGAGTCTTTGCTGCCGAAGCTGTGACTGCCGATTCGGAAGTCCTTGAGGAGCGTCAGAAGCGGCTTCCCTACGT
CCCAGAGCCCTATTACCCGGAATCTGGATGGGACCGCCTCCGGGAGCTGTTTGGCAAAGATGAACAGCAGAGAAT
TTCAAAGGACCTTGCTAATATCTGTAAGACGGCAGCTACAGCAGGCATCATTGGCTGGGTGTATGGGGGAATACC
AGCTTTTATTCATGCTAAACAACAATACATTGAGCAGAGCCAGGCAGAAATTTATCATAACCGGTTTGATGCTGT
GCAATCTGCACATCGTGCTGCCACACGAGGCTTCATTCGTTATGGCTGGCGCTGGGGTTGGAGAACTGCAGTGTT
TGTGACTATATTCAACACAGTGAACACTAGTCTGAATGTATACCGAAATAAAGATGCCTTAAGCCATTTTGTAAT
TGCAGGAGCTGTCACGGGAAGTCTTTTTAGGATAAACGTAGGCCTGCGTGGCCTGGTGGCTGGTGGCATAATTGG
AGCCTTGCTGGGCACTCCTGTAGGAGGCCTGCTGATGGCATTTCAGAAGTACGCTGGTGAGACTGTTCAGGAAAG
AAAACAGAAGGATCGAAAGGCACTCCATGAGCTAAAACTGGAAGAGTGGAAAGGCAGACTACAAGTTACTGAGCA
CCTCCCTGAGAAAATTGAAAGTAGTTTACGGGAAGATGAACCTGAGAATGATGCTAAGAAAATTGAAGCACTGCT
AAACCTTCCTAGAAACCCTTCAGTAATAGATAAACAAGACAAGGACTGAAAGTGCTCTGAACTTGAAACTCACTG
GAGAGCTGAAGGGAGCTGCCATGTCCGATGAATGCCAACAGACAGGCCACTCTTTGGTCAGCCTGCTGACAAATT
TAAGTGCTGGTACCTGTGGTGGCAGTGGCTTGCTCTTGTCTTTTTCTTTTCTTTTTAACTAAGAATGGGGCTGTT
GTACTCTCACTTTACTTATCCTTAAATTTAAATACATACTTATGTTTGTATTAATCTATCAATATATGCATACAT
GGATATATCCACCCACCTAGATTTTAAGCAGTAAATAAAACATTTCGCAAAAGATTAAAGTTGAATTTTACAGTTT

FIGURE 4

></usr/seqdb2/sst/DNA/Dnaseqs.min/ss.DNA23318
><subunit 1 of 1, 285 aa, 1 stop
><MW: 32190, pI: 9.03, NX(S/T): 2
MEVPPPAPRSFLCRALCLFPRVFAAEAVTADSEVLEERQKRLPYVPEPYYPESGWDRLRELFGKDEQQRISKDLA
NICKTAATAGIIGWVYGGIPAFIHAKQQYIEQSQAEIYHNRFDAVQSAHRAATRGFIRYGWRWGWRTAVFVTIFN
TVNTSLNVYRNKDALSHFVIAGAVTGSLFRINVGLRGLVAGGIIGALLGTPVGGLLMAFQKYAGETVQERKQKDR
KALHELKLEEWKGRLQVTEHLPEKIESSLREDEPENDAKKIEALLNLPRNPSVIDKQDKD

Important Features:
Signal Peptide:
amino acids 1-24

Transmembrane domains:
amino acids 76-96 and 171-195

N-glycosylation site:
amino acids 153-156

FIGURE 5

CGGACGCGTGGGCGCGGGACGCCGGCAGGGTTGTGGCGCAGCAGTCTCCTTCCTGCGCGCGCGCCTGAAGTCGGC
GTGGGCGTTTGAGGAAGCTGGGATACAGCATTTAATGAAAAATTTATGCTTAAGAAGTAAAAATGGCAGGCTTCC
TAGATAATTTTCGTTGGCCAGAATGTGAATGTATTGACTGGAGTGAGAGAAGAAATGCTGTGGCATCTGTTGTCG
CAGGTATATTGTTTTTTACAGGCTGGTGGATAATGATTGATGCAGCTGTGGTGTATCCTAAGCCAGAACAGTTGA
ACCATGCCTTTCACACATGTGGTGTATTTTCCACATTGGCTTTCTTCATGATAAATGCTGTATCCAATGCTCAGG
TGAGAGGTGATAGCTATGAAAGCGGCTGTTTAGGAAGAACAGGTGCTCGAGTTTGGCTTTTCATTGGTTTCATGT
TGATGTTTGGGTCACTTATTGCTTCCATGTGGATTCTTTTTGGTGCATATGTTACCCAAAATACTGATGTTTATC
CGGGACTAGCTGTGTTTTTTCAAAATGCACTTATATTTTTTAGCACTCTGATCTACAAATTTGGAAGAACCGAAG
AGCTATGGACCTGAGATCACTTCTTAAGTCACATTTTCCTTTTGTTATATTCTGTTTGTAGATAGGTTTTTTATC
TCTCAGTACACATTGCCAAATGGAGTAGATTGTACATTAAATGTTTTGTTTCTTTACATTTTTATGTTCTGAGTT
TTGAAATAGTTTTATGAAATTTCTTTATTTTTCATTGCATAGACTGTTAATATGTATATAATACAAGACTATATG
AATTGGATAATGAGTATCAGTTTTTTATTCCTGAGATTTAGAACTTGATCTACTCCCTGAGCCAGGGTTACATCA
TCTTGTCATTTTAGAAGTAACCACTCTTGTCTCTCTGGCTGGGCACGGTGGCTCATGCCTGTAATCCCAGCACTT
TGGGAGGCCGAGGCGGGCCGATTGCTTGAGGTCAAGTGTTTGAGACCAGCCTGGCCAACATGGCGAAACCCCATC
TACTAAAAATACAAAAATTAGCCAGGCATGGTGGTGGGTGCCTGTAATCCCAGCTACCTGGGAGGCTGAGGCAGG
AGAATCGCTTGAACCCGGGGGGCAGAGGTTGCAGTGAGCTGAGTTTGCGCCACTGCACTCTAGCCTGGGGGAGAA
AGTGAAACTCCCTCTCAAAAAAAAGACCACTCTCAGTATCTCTGATTTCTGAAGATGTACAAAAAAATATAGCTT
CATATATCTGGAATGAGCACTGAGCCATAAAAGGTTTTCAGCAAGTTGTAACTTATTTTGGCCTAAAAATGAGGT
TTTTTTGGTAAAGAAAAAATATTTGTTCTTATGTATTGAAGAAGTGTACTTTTATATAATGATTTTTTAAATGCC
CAAAGGACTAGTTTGAAAGCTTCTTTTAAAAAGAATTCCTCTAATATGACTTTATGTGAGAA

FIGURE 6

MAGFLDNFRWPECECIDWSERRNAVASVVAGILFFTGWWIMIDAAVVYPKPEQLNHAFHTCGVFSTLAFFMINAV
SNAQVRGDSYESGCLGRTGARVWLFIGFMLMFGSLIASMWILFGAYVTQNTDVYPGLAVFFQNALIFFSTLIYKF
GRTEELWT

Important features:
Signal peptide:
amino acids 1-44

Transmembrane domains:
amino acids 23-42 (type II), 60-80, 97-117, 128-148

FIGURE 7

GCGTGGTTTTTGTTCTGCAATAGGCGGCTTAGAGGGAGGGGCTTTTTCGCCTATACCTACTGTAGCTTCTCCACG
TATGGACCCTAAAGGCTACTGCTGCTACTACGGGGCTAGACAGTTACTGTCTCAGCTCTAGGATGTGCGTTCTTC
CACTAGAAGCTCTTCTGAGGGAGGTAATTAAAAAACAGTGGAATGGAAAAACAGTGCTGTAGTCATCCTGTAATA
TGCTCCTTGTCAACAATGTATACATTCCTGCTAGGTGCCATATTCATTGCTTTAAGCTCAAGTCGCATCTTACTA
GTGAAGTATTCTGCCAATGAAGAAAACAAGTATGATTATCTTCCAACTACTGTGAATGTGTGCTCAGAACTGGTG
AAGCTAGTTTTCTGTGTGCTTGTGTCATTCTGTGTTATAAAGAAAGATCATCAAAGTAGAAATTTGAAATATGCT
TCCTGGAAGGAATTCTCTGATTTCATGAAGTGGTCCATTCCTGCCTTTCTTTATTTCCTGGATAACTTGATTGTC
TTCTATGTCCTGTCCTATCTTCAACCAGCCATGGCTGTTATCTTCTCAAATTTTAGCATTATAACAACAGCTCTT
CTATTCAGGATAGTGCTGAAGAGGCGTCTAAACTGGATCCAGTGGGCTTCCCTCCTGACTTTATTTTTGTCTATT
GTGGCCTTGACTGCCGGGACTAAAACTTTACAGCACAACTTGGCAGGACGTGGATTTCATCACGATGCCTTTTTC
AGCCCTTCCAATTCCTGCCTTCTTTTCAGAAGTGAGTGTCCCAGAAAAGACAATTGTACAGCAAAGGAATGGACT
TTTCCTGAAGCTAAATGGAACACCACAGCCAGAGTTTTCAGTCACATCCGTCTTGGCATGGGCCATGTTCTTATT
ATAGTCCAGTGTTTTATTTCTTCAATGGCTAATATCTATAATGAAAAGATACTGAAGGAGGGGAACCAGCTCACT
GAAAGCATCTTCATACAGAACAGCAAACTCTATTTCTTTGGCATTCTGTTTAATGGGCTGACTCTGGGCCTTCAG
AGGAGTAACCGTGATCAGATTAAGAACTGTGGATTTTTTTATGGCCACAGTGCATTTTCAGTAGCCCTTATTTTT
GTAACTGCATTCCAGGGCCTTTCAGTGGCTTTCATTCTGAAGTTCCTGGATAACATGTTCCATGTCTTGATGGCC
CAGGTTACCACTGTCATTATCACAACAGTGTCTGTCCTGGTCTTTGACTTCAGGCCCTCCCTGGAATTTTTCTTG
GAAGCCCCATCAGTCCTTCTCTCTATATTTATTTATAATGCCAGCAAGCCTCAAGTTCCGGAATACGCACCTAGG
CAAGAAAGGATCCGAGATCTAAGTGGCAATCTTTGGGAGCGTTCCAGTGGGGATGGAGAAGAACTAGAAAGACTT
ACCAAACCCAAGAGTGATGAGTCAGATGAAGATACTTTCTAACTGGTACCCACATAGTTTGCAGCTCTCTTGAAC
CTTATTTTCACATTTTCAGTGTTTGTAATATTTATCTTTTCACTTTGATAAACCAGAAATGTTTCTAAATCCTAA
TATTCTTTGCATATATCTAGCTACTCCCTAAATGGTTCCATCCAAGGCTTAGAGTACCCAAAGGCTAAGAAATTC
TAAAGAACTGATACAGGAGTAACAATATGAAGAATTCATTAATATCTCAGTACTTGATAAATCAGAAAGTTATAT
GTGCAGATTATTTTCCTTGGCCTTCAAGCTTCCAAAAAACTTGTAATAATCATGTTAGCTATAGCTTGTATATAC
ACATAGAGATCAATTTGCCAAATATTCACAATCATGTAGTTCTAGTTTACATGCCAAAGTCTTCCCTTTTTAACA
TTATAAAAGCTAGGTTGTCTCTTGAATTTTGAGGCCCTAGAGATAGTCATTTTGCAAGTAAAGAGCAACGGGACC
CTTTCTAAAAACGTTGGTTGAAGGACCTAAATACCTGGCCATACCATAGATTTGGGATGATGTAGTCTGTGCTAA
ATATTTTGCTGAAGAAGCAGTTTCTCAGACACAACATCTCAGAATTTTAATTTTTAGAAATTCATGGGAAATTGG
ATTTTTGTAATAATCTTTTGATGTTTTAAACATTGGTTCCCTAGTCACCATAGTTACCACTTGTATTTTAAGTCA
TTTAAACAAGCCACGGTGGGGCTTTTTTCTCCTCAGTTTGAGGAGAAAAATCTTGATGTCATTACTCCTGAATTA
TTACATTTTGGAGAATAAGAGGGCATTTTATTTTATTAGTTACTAATTCAAGCTGTGACTATTGTATATCTTTCC
AAGAGTTGAAATGCTGGCTTCAGAATCATACCAGATTGTCAGTGAAGCTGATGCCTAGGAACTTTTAAAGGGATC
CTTTCAAAAGGATCACTTAGCAAACACATGTTGACTTTTAACTGATGTATGAATATTAATACTCTAAAAATAGAA
AGACCAGTAATATATAAGTCACTTTACAGTGCTACTTCACACTTAAAAGTGCATGGTATTTTTCATGGTATTTTG
CATGCAGCCAGTTAACTCTCGTAGATAGAGAAGTCAGGTGATAGATGATATTAAAAATTAGCAAACAAAAGTGAC
TTGCTCAGGGTCATGCAGCTGGGTGATGATAGAAGAGTGGGCTTTAACTGGCAGGCCTGTATGTTTACAGACTAC
CATACTGTAAATATGAGCTTTATGGTGTCATTCTCAGAAACTTATACATTTCTGCTCTCCTTTCTCCTAAGTTTC
ATGCAGATGAATATAAGGTAATATACTATTATATAATTCATTTGTGATATCCACAATAATATGACTGGCAAGAAT
TGGTGGAAATTTGTAATTAAAATAATTATTAAACCT

FIGURE 8

MEKQCCSHPVICSLSTMYTFLLGAIFIALSSSRILLVKYSANEENKYDYLPTTVNVCSELVKLVFCVLVSFCVIK
KDHQSRNLKYASWKEFSDFMKWSIPAFLYFLDNLIVFYVLSYLQPAMAVIFSNFSIITTALLFRIVLKRRLNWIQ
WASLLTLFLSIVALTAGTKTLQHNLAGRGFHHDAFFSPSNSCLLFRSECPRKDNCTAKEWTFPEAKWNTTARVFS
HIRLGMGHVLIIVQCFISSMANIYNEKILKEGNQLTESIFIQNSKLYFFGILFNGLTLGLQRSNRDQIKNCGFFY
GHSAFSVALIFVTAFQGLSVAFILKFLDNMFHVLMAQVTTVIITTVSVLVFDFRPSLEFFLEAPSVLLSIFIYNA
SKPQVPEYAPRQERIRDLSGNLWERSSGDGEELERLTKPKSDESDEDTF

Transmembrane domains:
amino acids 16-36 (type II), 50-74, 147-168, 229-250, 271-293, 298-318, 328-368

N-glycosylation sites.
amino acids 128-132, 204-208, 218-222, 374-378

Glycosaminoglycan attachment site.
amino acids 402-406

N-myristoylation sites.
amino acids 257-263, 275-281, 280-286, 284-290, 317-323

FIGURE 9

GGGGCTTCGGCGCCAGCGGCCAGCGCTAGTCGGTCTGGTAAGGATTTACAAAAGGTGCAGGTATGAGCAGGTCTG
AAGACTAACATTTTGTGAAGTTGTAAAACAGAAAACCTGTTAGAAATGTGGTGGTTTCAGCAAGGCCTCAGTTTC
CTTCCTTCAGCCCTTGTAATTTGGACATCTGCTGCTTTCATATTTTCATACATTACTGCAGTAACACTCCACCAT
ATAGACCCGGCTTTACCTTATATCAGTGACACTGGTACAGTAGCTCCAGAAAAATGCTTATTTGGGGCAATGCTA
AATATTGCGGCAGTTTTATGCATTGCTACCATTTATGTTCGTTATAAGCAAGTTCATGCTCTGAGTCCTGAAGAG
AACGTTATCATCAAATTAAACAAGGCTGGCCTTGTACTTGGAATACTGAGTTGTTTAGGACTTTCTATTGTGGCA
AACTTCCAGAAAACAACCCTTTTTGCTGCACATGTAAGTGGAGCTGTGCTTACCTTTGGTATGGGCTCATTATAT
ATGTTTGTTCAGACCATCCTTTCCTACCAAATGCAGCCCAAAATCCATGGCAAACAAGTCTTCTGGATCAGACTG
TTGTTGGTTATCTGGTGTGGAGTAAGTGCACTTAGCATGCTGACTTGCTCATCAGTTTTGCACAGTGGCAATTTT
GGGACTGATTTAGAACAGAAACTCCATTGGAACCCCGAGGACAAAGGTTATGTGCTTCACATGATCACTACTGCA
GCAGAATGGTCTATGTCATTTTCCTTCTTTGGTTTTTTCCTGACTTACATTCGTGATTTTCAGAAAATTTCTTTA
CGGGTGGAAGCCAATTTACATGGATTAACCCTCTATGACACTGCACCTTGCCCTATTAACAATGAACGAACACGG
CTACTTTCCAGAGATATTTGATGAAAGGATAAAATATTTCTGTAATGATTATGATTCTCAGGGATTGGGGAAAGG
TTCACAGAAGTTGCTTATTCTTCTCTGAAATTTTCAACCACTTAATCAAGGCTGACAGTAACACTGATGAATGCT
GATAATCAGGAAACATGAAAGAAGCCATTTGATAGATTATTCTAAAGGATATCATCAAGAAGACTATTAAAAACA
CCTATGCCTATACTTTTTTATCTCAGAAAATAAAGTCAAAAGACTATG

FIGURE 10

MWWFQQGLSFLPSALVIWTSAAFIFSYITAVTLHHIDPALPYISDTGTVAPEKCLFGAMLNIAAVLCIATIYVRY
KQVHALSPEENVIIKLNKAGLVLGILSCLGLSIVANFQKTTLFAAHVSGAVLTFGMGSLYMFVQTILSYQMQPKI
HGKQVFWIRLLLVIWCGVSALSMLTCSSVLHSGNFGTDLEQKLHWNPEDKGYVLHMITTAAEWSMSFSFFGFFLT
YIRDFQKISLRVEANLHGLTLYDTAPCPINNERTRLLSRDI

FIGURE 11

CCCACGCGTCCGCCCGCCGCTGCGTCCCGGAGTGCAAGTGAGCTTCTCGGCTGCCCCGCGGGCCGGGGTGCGGAG
CCGACATGCGCCCGCTTCTCGGCCTCCTTCTGGTCTTCGCCGGCTGCACCTTCGCCTTGTACTTGCTGTCGACGC
GACTGCCCCGCGGGCGGAGACTGGGCTCCACCGAGGAGGCTGGAGGCAGGTCGCTGTGGTTCCCCTCCGACCTGG
CAGAGCTGCGGGAGCTCTCTGAGGTCCTTCGAGAGTACCGGAAGGAGCACCAGGCCTACGTGTTCCTGCTCTTCT
GCGGCGCCTACCTCTACAAACAGGGCTTTGCCATCCCCGGCTCCAGCTTCCTGAATGTTTTAGCTGGTGCCTTGT
TTGGGCCATGGCTGGGGCTTCTGCTGTGCTGTGTGTTGACCTCGGTGGGTGCCACATGCTGCTACCTGCTCTCCA
GTATTTTTGGCAAACAGTTGGTGGTGTCCTACTTTCCTGATAAAGTGGCCCTGCTGCAGAGAAAGGTGGAGGAGA
ACAGAAACAGCTTGTTTTTTTTCTTATTGTTTTTGAGACTTTTCCCCATGACACCAAACTGGTTCTTGAACCTCT
CGGCCCCAATTCTGAACATTCCCATCGTGCAGTTCTTCTTCTCAGTTCTTATCGGTTTGATCCCATATAATTTCA
TCTGTGTGCAGACAGGGTCCATCCTGTCAACCCTAACCTCTCTGGATGCTCTTTTCTCCTGGGACACTGTCTTTA
AGCTGTTGGCCATTGCCATGGTGGCATTAATTCCTGGAACCCTCATTAAAAAATTTAGTCAGAAACATCTGCAAT
TGAATGAAACAAGTACTGCTAATCATATACACAGTAGAAAAGACACATGATCTGGATTTTCTGTTTGCCACATCC
CTGGACTCAGTTGCTTATTTGTGTAATGGATGTGGTCCTCTAAAGCCCCTCATTGTTTTTGATTGCCTTCTATAG
GTGATGTGGACACTGTGCATCAATGTGCAGTGTCTTTTCAGAAAGGACACTCTGCTCTTGAAGGTGTATTACATC
AGGTTTTCAAACCAGCCCTGGTGTAGCAGACACTGCAACAGATGCCTCCTAGAAAATGCTGTTTGTGGCCGGGCG
CGGTGGCTCACGCCTGTAATCCCAGCACTTTGGGAGGCCGAGGCCGGTGATTCACAAGGTCAGGAGTTCAAGACC
AGCCTGGCCAAGATGGTGAAATCCTGTCTCTAATAAAAATACAAAAATTAGCCAGGCGTGGTGGCAGGCACCTGT
AATCCCAGCTACTCGGGAGGCTGAGGCAGGAGAATTGCTTGAACCAAGGTGGCAGAGGTTGCAGTAAGCCAAGAT
CACACCACTGCACTCCAGCCTGGGTGATAGAGTGAGACACTGTCTTGAC

FIGURE 12

MRPLLGLLLVFAGCTFALYLLSTRLPRGRRLGSTEEAGGRSLWFPSDLAELRELSEVLREYRKEHQAYVFLLFCG
AYLYKQGFAIPGSSFLNVLAGALFGPWLGLLLCCVLTSVGATCCYLLSSIFGKQLVVSYFPDKVALLQRKVEENR
NSLFFFLLFLRLFPMTPNWFLNLSAPILNIPIVQFFFSVLIGLIPYNFICVQTGSILSTLTSLDALFSWDTVFKL
LAIAMVALIPGTLIKKFSQKHLQLNETSTANHIHSRKDT

Important features:
Signal peptide:
amino acids 1-17

Transmembrane domains:
amino acids 101-123, 189-211

N-glycosylation sites.
amino acids 172-176, 250-254 cAMP- and cGMP-dependent protein kinase phosphorylation site.
amino acids 240-244, 261-265

N-myristoylation site.
amino acids 13-19, 104-110, 115-121, 204-210

Amidation site.
amino acids 27-31

Prokaryotic membrane lipoprotein lipid attachment site.
amino acids 4-15

Protein splicing proteins.
amino acids 25-31

Sugar transport proteins.
amino acids 162-172

FIGURE 13

CGGACGCGTGGGCGGACGCGTGGGGGAGAGCCGCAGTCCCGGCTGCAGCACCTGGGAGAAGGCAGACCGTGTGAG
GGGGCCTGTGGCCCCAGCGTGCTGTGGCCTCGGGGAGTGGGAAGTGGAGGCAGGAGCCTTCCTTACACTTCGCCA
TGAGTTTCCTCATCGACTCCAGCATCATGATTACCTCCCAGATACTATTTTTTGGATTTGGGTGGCTTTTCTTCA
TGCGCCAATTGTTTAAAGACTATGAGATACGTCAGTATGTTGTACAGGTGATCTTCTCCGTGACGTTTGCATTTT
CTTGCACCATGTTTGAGCTCATCATCTTTGAAATCTTAGGAGTATTGAATAGCAGCTCCCGTTATTTTCACTGGA
AAATGAACCTGTGTGTAATTCTGCTGATCCTGGTTTTCATGGTGCCTTTTTACATTGGCTATTTTATTGTGAGCA
ATATCCGACTACTGCATAAACAACGACTGCTTTTTTCCTGTCTCTTATGGCTGACCTTTATGTATTTCTTCTGGA
AACTAGGAGATCCCTTTCCCATTCTCAGCCCAAAACATGGGATCTTATCCATAGAACAGCTCATCAGCCGGGTTG
GTGTGATTGGAGTGACTCTCATGGCTCTTCTTTCTGGATTTGGTGCTGTCAACTGCCCATACACTTACATGTCTT
ACTTCCTCAGGAATGTGACTGACACGGATATTCTAGCCCTGGAACGGCGACTGCTGCAAACCATGGATATGATCA
TAAGCAAAAAGAAAAGGATGGCAATGGCACGGAGAACAATGTTCCAGAAGGGGGAAGTGCATAACAAACCATCAG
GTTTCTGGGGAATGATAAAAAGTGTTACCACTTCAGCATCAGGAAGTGAAAATCTTACTCTTATTCAACAGGAAG
TGGATGCTTTGGAAGAATTAAGCAGGCAGCTTTTTCTGGAAACAGCTGATCTATATGCTACCAAGGAGAGAATAG
AATACTCCAAAACCTTCAAGGGGAAATATTTTAATTTTCTTGGTTACTTTTTCTCTATTTACTGTGTTTGGAAAA
TTTTCATGGCTACCATCAATATTGTTTTTGATCGAGTTGGGAAAACGGATCCTGTCACAAGAGGCATTGAGATCA
CTGTGAATTATCTGGGAATCCAATTTGATGTGAAGTTTTGGTCCCAACACATTTCCTTCATTCTTGTTGGAATAA
TCATCGTCACATCCATCAGAGGATTGCTGATCACTCTTACCAAGTTCTTTTATGCCATCTCTAGCAGTAAGTCCT
CCAATGTCATTGTCCTGCTATTAGCACAGATAATGGGCATGTACTTTGTCTCCTCTGTGCTGCTGATCCGAATGA
GTATGCCTTTAGAATACCGCACCATAATCACTGAAGTCCTTGGAGAACTGCAGTTCAACTTCTATCACCGTTGGT
TTGATGTGATCTTCCTGGTCAGCGCTCTCTCTAGCATACTCTTCCTCTATTTGGCTCACAAACAGGCACCAGAGA
AGCAAATGGCACCTTGAACTTAAGCCTACTACAGACTGTTAGAGGCCAGTGGTTTCAAAATTTAGATATAAGAGG
GGGGAAAAAATGGAACCAGGGCCTGACATTTTATAAACAAACAAAATGCTATGGTAGCATTTTTCACCTTCATAGC
ATACTCCTTCCCCGTCAGGTGATACTATGACCATGAGTAGCATCAGCCAGAACATGAGAGGGAGAACTAACTCAA
GACAATACTCAGCAGAGAGCATCCCGTGTGGATATGAGGCTGGTGTAGAGGCGGAGAGGAGCCAAGAAACTAAAG
GTGAAAAATACACTGGAACTCTGGGGCAAGACATGTCTATGGTAGCTGAGCCAAACACGTAGGATTTCCGTTTTA
AGGTTCACATGGAAAAGGTTATAGCTTTGCCTTGAGATTGACTCATTAAAATCAGAGACTGTAACAAAAAAAAAA
AAAAAAAAAAAGGGCGGCCGCGACTCTAGAGTCGACCTGCAGAAGCTTGGCCGCCATGGCCCAACTTGTTTATTG
CAGCTTATAATG

FIGURE 14

MSFLIDSSIMITSQILFFGFGWLFFMRQLFKDYEIRQYVVQVIFSVTFAFSCTMFELIIFEILGVLNSSSRYFHW
KMNLCVILLILVFMVPFYIGYFIVSNIRLLHKQRLLFSCLLWLTFMYFFWKLGDPFPILSPKHGILSIEQLISRV
GVIGVTLMALLSGFGAVNCPYTYMSYFLRNVTDTDILALERRLLQTMDMIISKKKRMAMARRTMFQKGEVHNKPS
GFWGMIKSVTTSASGSENLTLIQQEVDALEELSRQLFLETADLYATKERIEYSKTFKGKYFNFLGYFFSIYCVWK
IFMATINIVFDRVGKTDPVTRGIEITVNYLGIQFDVKFWSQHISFILVGIIIVTSIRGLLITLTKFFYAISSSKS
SNVIVLLLAQIMGMYFVSSVLLIRMSMPLEYRTIITEVLGELQFNFYHRWFDVIFLVSALSSILFLYLAHKQAPE
KQMAP

Important features:
Signal peptide:
amino acids 1-23

Potential transmembrane domains:
amino acids 37-55, 81-102, 150-168, 288-311, 338-356, 375-398, 425-444

N-glycosylation sites.
amino acids 67-70, 180-183 and 243-246

Eukaryotic cobalamin-binding proteins
amino acids 151-160

FIGURE 15

GACGGAAGAACAGCGCTCCCGAGGCCGCGGGAGCCTGCAGAGAGGACAGCCGGCCTGCGCCGGGACATGCGGCCC
CAGGAGCTCCCCAGGCTCGCGTTCCCGTTGCTGCTGTTGCTGTTGCTGCTGCTGCCGCCGCCGCCGTGCCCTGCC
CACAGCGCCACGCGCTTCGACCCCACCTGGGAGTCCCTGGACGCCCGCCAGCTGCCCGCGTGGTTTGACCAGGCC
AAGTTCGGCATCTTCATCCACTGGGGAGTGTTTTCCGTGCCCAGCTTCGGTAGCGAGTGGTTCTGGTGGTATTGG
CAAAAGGAAAAGATACCGAAGTATGTGGAATTTATGAAAGATAATTACCCTCCTAGTTTCAAATATGAAGATTTT
GGACCACTATTTACAGCAAAATTTTTTAATGCCAACCAGTGGGCAGATATTTTTCAGGCCTCTGGTGCCAAATAC
ATTGTCTTAACTTCCAAACATCATGAAGGCTTTACCTTGTGGGGGTCAGAATATTCGTGGAACTGGAATGCCATA
GATGAGGGGCCCAAGAGGGACATTGTCAAGGAACTTGAGGTAGCCATTAGGAACAGAACTGACCTGCGTTTTGGA
CTGTACTATTCCCTTTTTGAATGGTTTCATCCGCTCTTCCTTGAGGATGAATCCAGTTCATTCCATAAGCGGCAA
TTTCCAGTTTCTAAGACATTGCCAGAGCTCTATGAGTTAGTGAACAACTATCAGCCTGAGGTTCTGTGGTCGGAT
GGTGACGGAGGAGCACCGGATCAATACTGGAACAGCACAGGCTTCTTGGCCTGGTTATATAATGAAAGCCCAGTT
CGGGGCACAGTAGTCACCAATGATCGTTGGGGAGCTGGTAGCATCTGTAAGCATGGTGGCTTCTATACCTGCAGT
GATCGTTATAACCCAGGACATCTTTTGCCACATAAATGGGAAAACTGCATGACAATAGACAAACTGTCCTGGGGC
TATAGGAGGGAAGCTGGAATCTCTGACTATCTTACAATTGAAGAATTGGTGAAGCAACTTGTAGAGACAGTTTCA
TGTGGAGGAAATCTTTTGATGAATATTGGGCCCACACTAGATGGCACCATTTCTGTAGTTTTTGAGGAGCGACTG
AGGCAAGTGGGGTCCTGGCTAAAAGTCAATGGAGAAGCTATTTATGAAACCTATACCTGGCGATCCCAGAATGAC
ACTGTCACCCCAGATGTGTGGTACACATCCAAGCCTAAAGAAAAATTAGTCTATGCCATTTTTCTTAAATGGCCC
ACATCAGGACAGCTGTTCCTTGGCCATCCCAAAGCTATTCTGGGGGCAACAGAGGTGAAACTACTGGGCCATGGA
CAGCCACTTAACTGGATTTCTTTGGAGCAAAATGGCATTATGGTAGAACTGCCACAGCTAACCATTCATCAGATG
CCGTGTAAATGGGGCTGGGCTCTAGCCCTAACTAATGTGATCTAAAGTGCAGCAGAGTGGCTGATGCTGCAAGTT
ATGTCTAAGGCTAGGAACTATCAGGTGTCTATAATTGTAGCACATGGAGAAAGCAATGTAAACTGGATAAGAAAA
TTATTTGGCAGTTCAGCCCTTTCCCTTTTTCCCACTAAATTTTTCTTAAATTACCCATGTAACCATTTTAACTCT
CCAGTGCACTTTGCCATTAAAGTCTCTTCACATTGATTTGTTTCCATGTGTGACTCAGAGGTGAGAATTTTTTCA
CATTATAGTAGCAAGGAATTGGTGGTATTATGGACCGAACTGAAAATTTTATGTTGAAGCCATATCCCCCATGAT
TATATAGTTATGCATCACTTAATATGGGGATATTTTCTGGGAAATGCATTGCTAGTCAATTTTTTTTTGTGCCAA
CATCATAGAGTGTATTTACAAAATCCTAGATGGCATAGCCTACTACACACCTAATGTGTATGGTATAGACTGTTG
CTCCTAGGCTACAGACATATACAGCATGTTACTGAATACTGTAGGCAATAGTAACAGTGGTATTTGTATATCGAA
ACATATGGAAACATAGAGAAGGTACAGTAAAAATACTGTAAAATAAATGGTGCACCTGTATAGGGCACTTACCAC
GAATGGAGCTTACAGGACTGGAAGTTGCTCTGGGTGAGTCAGTGAGTGAATGTGAAGGCCTAGGACATTATTGAA
CACTGCCAGACGTTATAAATACTGTATGCTTAGGCTACACTACATTTATAAAAAAAAGTTTTTCTTTCTTCAATT
ATAAATTAACATAAGTGTACTGTAACTTTACAAACGTTTTAATTTTTAAAACCTTTTTGGCTCTTTTGTAATAAC
ACTTAGCTTAAAACATAAACTCATTGTGCAAATGTAA

FIGURE 16

MRPQELPRLAFPLLLLLLLLLPPPPCPAHSATRFDPTWESLDARQLPAWFDQAKFGIFIHWGVFSVPSFGSEWFW
WYWQKEKIPKYVEFMKDNYPPSFKYEDFGPLFTAKFFNANQWADIFQASGAKYIVLTSKHHEGFTLWGSEYSWNW
NAIDEGPKRDIVKELEVAIRNRTDLRFGLYYSLFEWFHPLFLEDESSSFHKRQFPVSKTLPELYELVNNYQPEVL
WSDGDGGAPDQYWNSTGFLAWLYNESPVRGTVVTNDRWGAGSICKHGGFYTCSDRYNPGHLLPHKWENCMTIDKL
SWGYRREAGISDYLTIEELVKQLVETVSCGGNLLMNIGPTLDGTISVVFEERLRQVGSWLKVNGEAIYETYTWRS
QNDTVTPDVWYTSKPKEKLVYAIFLKWPTSGQLFLGHPKAILGATEVKLLGHGQPLNWISLEQNGIMVELPQLTI
HQMPCKWGWALALTNVI

Signal sequence:
amino acids 1-28

N-glycosylation site.
amino acids 171-175, 239-243, 377-381

Casein kinase II phosphorylation site.
amino acids 32-36, 182-186, 209-213, 227-231, 276-280, 315-319, 375-375

Tyrosine kinase phosphorylation site.
amino acids 361-369, 389-397

N-myristoylation site.
amino acids 143-149, 178-184, 255-261, 272-278, 428-434

Leucine zipper pattern.
amino acids 410-432

Alpha-L-fucosidase putative active site.
amino acids 283-295

FIGURE 17

CCCACGCGTCCGCTGGTGTTAGATCGAGCAACCCTCTAAAAGCAGTTTAGAGTGGTAAAAAAAAAAAAAAACACA
CCAAACGCTCGCAGCCACAAAAGGGATGAAATTTCTTCTGGACATCCTCCTGCTTCTCCCGTTACTGATCGTCTG
CTCCCTAGAGTCCTTCGTGAAGCTTTTTATTCCTAAGAGGAGAAAATCAGTCACCGGCGAAATCGTGCTGATTAC
AGGAGCTGGGCATGGAATTGGGAGACTGACTGCCTATGAATTTGCTAAACTTAAAAGCAAGCTGGTTCTCTGGGA
TATAAATAAGCATGGACTGGAGGAAACAGCTGCCAAATGCAAGGGACTGGGTGCCAAGGTTCATACCTTTGTGGT
AGACTGCAGCAACCGAGAAGATATTTACAGCTCTGCAAAGAAGGTGAAGGCAGAAATTGGAGATGTTAGTATTTT
AGTAAATAATGCTGGTGTAGTCTATACATCAGATTTGTTTGCTACACAAGATCCTCAGATTGAAAAGACTTTTGA
AGTTAATGTACTTGCACATTTCTGGACTACAAAGGCATTTCTTCCTGCAATGACGAAGAATAACCATGGCCATAT
TGTCACTGTGGCTTCGGCAGCTGGACATGTCTCGGTCCCCTTCTTACTGGCTTACTGTTCAAGCAAGTTTGCTGC
TGTTGGATTTCATAAAACTTTGACAGATGAACTGGCTGCCTTACAAATAACTGGAGTCAAAACAACATGTCTGTG
TCCTAATTTCGTAAACACTGGCTTCATCAAAAATCCAAGTACAAGTTTGGGACCCACTCTGGAACCTGAGGAAGT
GGTAAACAGGCTGATGCATGGGATTCTGACTGAGCAGAAGATGATTTTTATTCCATCTTCTATAGCTTTTTTAAC
AACATTGGAAAGGATCCTTCCTGAGCGTTTCCTGGCAGTTTTAAAACGAAAAATCAGTGTTAAGTTTGATGCAGT
TATTGGATATAAAATGAAAGCGCAATAAGCACCTAGTTTTCTGAAAACTGATTTACCAGGTTTAGGTTGATGTCA
TCTAATAGTGCCAGAATTTTAATGTTTGAACTTCTGTTTTTTCTAATTATCCCCATTTCTTCAATATCATTTTTG
AGGCTTTGGCAGTCTTCATTTACTACCACTTGTTCTTTAGCCAAAAGCTGATTACATATGATATAAACAGAGAAA
TACCTTTAGAGGTGACTTTAAGGAAAATGAAGAAAAAGAACCAAAATGACTTTATTAAAATAATTTCCAAGATTA
TTTGTGGCTCACCTGAAGGCTTTGCAAAATTTGTACCATAACCGTTTATTTAACATATATTTTTATTTTTGATTG
CACTTAAATTTTGTATAATTTGTGTTTCTTTTTCTGTTCTACATAAAATCAGAAACTTCAAGCTCTCTAAATAAA
ATGAAGGACTATATCTAGTGGTATTTCACAATGAATATCATGAACTCTCAATGGGTAGGTTTCATCCTACCCATT
GCCACTCTGTTTCCTGAGAGATACCTCACATTCCAATGCCAAACATTTCTGCACAGGGAAGCTAGAGGTGGATAC
ACGTGTTGCAAGTATAAAAGCATCACTGGGATTTAAGGAGAATTGAGAGAATGTACCCACAAATGGCAGCAATAA
TAAATGGATCACACTTAAAAAAAAAAAAAAAAAAAAAAAAAAAAAAAAAAAAAAAAAAAAAAAAAAAAAAAAAAA
AAAAAAAAAAAAAAAAAAAAAAAAAAAAAAAAAAAAAAAAA

FIGURE 18

MKFLLDILLLLPLLIVCSLESFVKLFIPKRRKSVTGEIVLITGAGHGIGRLTAYEFAKLKSKL
VLWDINKHGLEETAAKCKGLGAKVHTFVVDCSNREDIYSSAKKVKAEIGDVSILVNNAGVVYT
SDLFATQDPQIEKTFEVNVLAHFWTTKAFLPAMTKNNHGHIVTVASAAGHVSVPFLLAYCSSK
FAAVGFHKTLTDELAALQITGVKTTCLCPNFVNTGFIKNPSTSLGPTLEPEEVVNRLMHGILT
EQKMIFIPSSIAFLTTLERILPERFLAVLKRKISVKFDAVIGYKMKAQ

Signal sequence:
amino acids 1-19 cAMP- and cGMP-dependent protein kinase phosphorylation site.
amino acids 30-34, 283-287

Casein kinase II phosphorylation site.
amino acids 52-56, 95-99, 198-202, 267-271

N-myristoylation site.
amino acids 43-49, 72-78, 122-128, 210-216

FIGURE 19

CCCACGCGTCCGCTCCGCGCCCTCCCCCCCGCCTCCCGTGCGGTCCGTCGGTGGCCTAGAGAT
GCTGCTGCCGCGGTTGCAGTTGTCGCGCACGCCTCTGCCCGCCAGCCCGCTCCACCGCCGTAG
CGCCCGAGTGTCGGGGGGCGCACCCGAGTCGGGCCATGAGGCCGGGAACCGCGCTACAGGCCG
TGCTGCTGGCCGTGCTGCTGGTGGGGCTGCGGGCCGCGACGGGTCGCCTGCTGAGTGCCTCGG
ATTTGGACCTCAGAGGAGGGCAGCCAGTCTGCCGGGGAGGGACACAGAGGCCTTGTTATAAAG
TCATTTACTTCCATGATACTTCTCGAAGACTGAACTTTGAGGAAGCCAAAGAAGCCTGCAGGA
GGGATGGAGGCCAGCTAGTCAGCATCGAGTCTGAAGATGAACAGAAACTGATAGAAAAGTTCA
TTGAAAACCTCTTGCCATCTGATGGTGACTTCTGGATTGGGCTCAGGAGGCGTGAGGAGAAAC
AAAGCAATAGCACAGCCTGCCAGGACCTTTATGCTTGGACTGATGGCAGCATATCACAATTTA
GGAACTGGTATGTGGATGAGCCGTCCTGCGGCAGCGAGGTCTGCGTGGTCATGTACCATCAGC
CATCGGCACCCGCTGGCATCGGAGGCCCCTACATGTTCCAGTGGAATGATGACCGGTGCAACA
TGAAGAACAATTTCATTTGCAAATATTCTGATGAGAAACCAGCAGTTCCTTCTAGAGAAGCTG
AAGGTGAGGAAACAGAGCTGACAACACCTGTACTTCCAGAAGAAACACAGGAAGAAGATGCCA
AAAAAACATTTAAAGAAAGTAGAGAAGCTGCCTTGAATCTGGCCTACATCCTAATCCCCAGCA
TTCCCCTTCTCCTCCTCCTTGTGGTCACCACAGTTGTATGTTGGGTTTGGATCTGTAGAAAAA
GAAAACGGGAGCAGCCAGACCCTAGCACAAAGAAGCAACACACCATCTGGCCCTCTCCTCACC
AGGGAAACAGCCCGGACCTAGAGGTCTACAATGTCATAAGAAAACAAAGCGAAGCTGACTTAG
CTGAGACCCGGCCAGACCTGAAGAATATTTCATTCCGAGTGTGTTCGGGAGAAGCCACTCCCG
ATGACATGTCTTGTGACTATGACAACATGGCTGTGAACCCATCAGAAAGTGGGTTTGTGACTC
TGGTGAGCGTGGAGAGTGGATTTGTGACCAATGACATTTATGAGTTCTCCCCAGACCAAATGG
GGAGGAGTAAGGAGTCTGGATGGGTGGAAAATGAAATATATGGTTATTAGGACATATAAAAAA
CTGAAACTGACAACAATGGAAAAGAAATGATAAGCAAAATCCTCTTATTTTCTATAAGGAAAA
TACACAGAAGGTCTATGAACAAGCTTAGATCAGGTCCTGTGGATGAGCATGTGGTCCCCACGA
CCTCCTGTTGGACCCCCACGTTTTGGCTGTATCCTTTATCCCAGCCAGTCATCCAGCTCGACC
TTATGAGAAGGTACCTTGCCCAGGTCTGGCACATAGTAGAGTCTCAATAAATGTCACTTGGTT
GGTTGTATCTAACTTTTAAGGGACAGAGCTTTACCTGGCAGTGATAAAGATGGGCTGTGGAGC
TTGGAAAACCACCTCTGTTTTCCTTGCTCTATACAGCAGCACATATTATCATACAGACAGAAA
ATCCAGAATCTTTTCAAAGCCCACATATGGTAGCACAGGTTGGCCTGTGCATCGGCAATTCTC
ATATCTGTTTTTTTCAAAGAATAAAATCAAATAAAGAGCAGGAAAAAAAAA

FIGURE 20

MRPGTALQAVLLAVLLVGLRAATGRLLSASDLDLRGGQPVCRGGTQRPCYKVIYFHDTSRRLN
FEEAKEACRRDGGQLVSIESEDEQKLIEKFIENLLPSDGDFWIGLRRREEKQSNSTACQDLYA
WTDGSISQFRNWYVDEPSCGSEVCVVMYHQPSAPAGIGGPYMFQWNDDRCNMKNNFICKYSDE
KPAVPSREAEGEETELTTPVLPEETQEEDAKKTFKESREAALNLAYILIPSIPLLLLLVVTTV
VCWVWICRKRKREQPDPSTKKQHTIWPSPHQGNSPDLEVYNVIRKQSEADLAETRPDLKNISF
RVCSGEATPDDMSCDYDNMAVNPSESGFVTLVSVESGFVTNDIYEFSPDQMGRSKESGWVENE
IYGY

Signal sequence:
amino acids 1-21

Transmembrane domain:
amino acids 235-254

N-glycosylation site.
amino acids 117-121, 312-316 cAMP- and cGMP-dependent protein kinase phosphorylation site.
amino acids 296-300

Casein kinase II phosphorylation site.
amino acids 28-32, 30-34, 83-87, 100-104, 214-218, 222-226, 299-303, 306-310, 323-327

N-myristoylation site.
amino acids 18-24, 37-43, 76-82, 146-152

FIGURE 21

AGGCTCCCGCGCGCGGCTGAGTGCGGACTGGAGTGGGAACCCGGGTCCCCGCGCTTAGAGAACACGCGATGACCA
CGTGGAGCCTCCGGCGGAGGCCGGCCCGCACGCTGGGACTCCTGCTGCTGGTCGTCTTGGGCTTCCTGGTGCTCC
GCAGGCTGGACTGGAGCACCCTGGTCCCTCTGCGGCTCCGCCATCGACAGCTGGGGCTGCAGGCCAAGGGCTGGA
ACTTCATGCTGGAGGATTCCACCTTCTGGATCTTCGGGGGCTCCATCCACTATTTCCGTGTGCCCAGGGAGTACT
GGAGGGACCGCCTGCTGAAGATGAAGGCCTGTGGCTTGAACACCCTCACCACCTATGTTCCGTGGAACCTGCATG
AGCCAGAAAGAGGCAAATTTGACTTCTCTGGGAACCTGGACCTGGAGGCCTTCGTCCTGATGGCCGCAGAGATCG
GGCTGTGGGTGATTCTGCGTCCAGGCCCCTACATCTGCAGTGAGATGGACCTCGGGGGCTTGCCCAGCTGGCTAC
TCCAAGACCCTGGCATGAGGCTGAGGACAACTTACAAGGGCTTCACCGAAGCAGTGGACCTTTATTTTGACCACC
TGATGTCCAGGGTGGTGCCACTCCAGTACAAGCGTGGGGGACCTATCATTGCCGTGCAGGTGGAGAATGAATATG
GTTCCTATAATAAAGACCCCGCATACATGCCCTACGTCAAGAAGGCACTGGAGGACCGTGGCATTGTGGAACTGC
TCCTGACTTCAGACAACAAGGATGGGCTGAGCAAGGGGATTGTCCAGGGAGTCTTGGCCACCATCAACTTGCAGT
CAACACACGAGCTGCAGCTACTGACCACCTTTCTCTTCAACGTCCAGGGGACTCAGCCCAAGATGGTGATGGAGT
ACTGGACGGGGTGGTTTGACTCGTGGGGAGGCCCTCACAATATCTTGGATTCTTCTGAGGTTTTGAAAACCGTGT
CTGCCATTGTGGACGCCGGCTCCTCCATCAACCTCTACATGTTCCACGGAGGCACCAACTTTGGCTTCATGAATG
GAGCCATGCACTTCCATGACTACAAGTCAGATGTCACCAGCTATGACTATGATGCTGTGCTGACAGAAGCCGGCG
ATTACACGGCCAAGTACATGAAGCTTCGAGACTTCTTCGGCTCCATCTCAGGCATCCCTCTCCCTCCCCCACCTG
ACCTTCTTCCCAAGATGCCGTATGAGCCCTTAACGCCAGTCTTGTACCTGTCTCTGTGGGACGCCCTCAAGTACC
TGGGGGAGCCAATCAAGTCTGAAAAGCCCATCAACATGGAGAACCTGCCAGTCAATGGGGGAAATGGACAGTCCT
TCGGGTACATTCTCTATGAGACCAGCATCACCTCGTCTGGCATCCTCAGTGGCCACGTGCATGATCGGGGGCAGG
TGTTTGTGAACACAGTATCCATAGGATTCTTGGACTACAAGACAACGAAGATTGCTGTCCCCCTGATCCAGGGTT
ACACCGTGCTGAGGATCTTGGTGGAGAATCGTGGGCGAGTCAACTATGGGGAGAATATTGATGACCAGCGCAAAG
GCTTAATTGGAAATCTCTATCTGAATGATTCACCCCTGAAAAACTTCAGAATCTATAGCCTGGATATGAAGAAGA
GCTTCTTTCAGAGGTTCGGCCTGGACAAATGGNGTTCCCTCCCAGAAACACCCACATTACCTGCTTTCTTCTTGG
GTAGCTTGTCCATCAGCTCCACGCCTTGTGACACCTTTCTGAAGCTGGAGGGCTGGGAGAAGGGGGTTGTATTCA
TCAATGGCCAGAACCTTGGACGTTACTGGAACATTGGACCCCAGAAGACGCTTTACCTCCCAGGTCCCTGGTTGA
GCAGCGGAATCAACCAGGTCATCGTTTTTGAGGAGACGATGGCGGGCCCTGCATTACAGTTCACGGAAACCCCCC
ACCTGGGCAGGAACCAGTACATTAAGTGAGCGGTGGCACCCCCTCCTGCTGGTGCCAGTGGGAGACTGCCGCCTC
CTCTTGACCTGAAGCCTGGTGGCTGCTGCCCCACCCCTCACTGCAAAAGCATCTCCTTAAGTAGCAACCTCAGGG
ACTGGGGGCTACAGTCTGCCCCTGTCTCAGCTCAAAACCCTAAGCCTGCAGGGAAAGGTGGGATGGCTCTGGGCC
TGGCTTTGTTGATGATGGCTTTCCTACAGCCCTGCTCTTGTGCCGAGGCTGTCGGGCTGTCTCTAGGGTGGGAGC
AGCTAATCAGATCGCCCAGCCTTTGGCCCTCAGAAAAAGTGCTGAAACGTGCCCTTGCACCGGACGTCACAGCCC
TGCGAGCATCTGCTGGACTCAGGCGTGCTCTTTGCTGGTTCCTGGGAGGCTTGGCCACATCCCTCATGGCCCCAT
TTTATCCCCGAAATCCTGGGTGTGTCACCAGTGTAGAGGGTGGGGAAGGGGTGTCTCACCTGAGCTGACTTTGTT
CTTCCTTCACAACCTTCTGAGCCTTCTTTGGGATTCTGGAAGGAACTCGGCGTGAGAAACATGTGACTTCCCCTT
TCCCTTCCCACTCGCTGCTTCCCACAGGGTGACAGGCTGGGCTGGAGAAACAGAAATCCTCACCCTGCGTCTTCC
CAAGTTAGCAGGTGTCTCTGGTGTTCAGTGAGGAGGACATGTGAGTCCTGGCAGAAGCCATGGCCCATGTCTGCA
CATCCAGGGAGGAGGACAGAAGGCCCAGCTCACATGTGAGTCCTGGCAGAAGCCATGGCCCATGTCTGCACATCC
AGGGAGGAGGACAGAAGGCCCAGCTCACATGTGAGTCCTGGCAGAAGCCATGGCCCATGTCTGCACATCCAGGGA
GGAGGACAGAAGGCCCAGCTCACATGTGAGTCCTGGCAGAAGCCATGGCCCATGTCTGCACATCCAGGGAGGAGG
ACAGAAGGCCCAGCTCAGTGGCCCCCGCTCCCCACCCCCCACGCCCGAACAGCAGGGGCAGAGCAGCCCTCCTTC
GAAGTGTGTCCAAGTCCGCATTTGAGCCTTGTTCTGGGGCCCAGCCCAACACCTGGCTTGGGCTCACTGTCCTGA
GTTGCAGTAAAGCTATAACCTTGAATCACAA

FIGURE 22

MTTWSLRRRPARTLGLLLLVVLGFLVLRRLDWSTLVPLRLRHRQLGLQAKGWNFMLEDSTFWI
FGGSIHYFRVPREYWRDRLLKMKACGLNTLTTYVPWNLHEPERGKFDFSGNLDLEAFVLMAAE
IGLWVILRPGPYICSEMDLGGLPSWLLQDPGMRLRTTYKGFTEAVDLYFDHLMSRVVPLQYKR
GGPIIAVQVENEYGSYNKDPAYMPYVKKALEDRGIVELLLTSDNKDGLSKGIVQGVLATINLQ
STHELQLLTTFLFNVQGTQPKMVMEYWTGWFDSWGGPHNILDSSEVLKTVSAIVDAGSSINLY
MFHGGTNFGFMNGAMHFHDYKSDVTSYDYDAVLTEAGDYTAKYMKLRDFFGSISGIPLPPPPD
LLPKMPYEPLTPVLYLSLWDALKYLGEPIKSEKPINMENLPVNGGNGQSFGYILYETSITSSG
ILSGHVHDRGQVFVNTVSIGFLDYKTTKIAVPLIQGYTVLRILVENRGRVNYGENIDDQRKGL
IGNLYLNDSPLKNFRIYSLDMKKSFFQRFGLDKWXSLPETPTLPAFFLGSLSISSTPCDTFLK
LEGWEKGVVFINGQNLGRYWNIGPQKTLYLPGPWLSSGINQVIVFEETMAGPALQFTETPHLG
RNQYIK

Signal sequence:
amino acids 1-27

Casein kinase II phosphorylation site.
amino acids 141-118, 253-257, 340-344, 395-399, 540-544, 560-564

N-myristoylation site.
amino acids 146-152, 236-242, 240-246, 244-250, 287-293, 309-315, 320-326, 366-372, 423-429, 425-431, 441-447, 503-509, 580-586

FIGURE 23

CCCACGCGTCCGATCTTACCAACAAAACACTCCTGAGGAGAAAGAAAGAGAGGGAGGGAGAGA
AAAAGAGAGAGAGAGAAACAAAAAACCAAAGAGAGAGAAAAAAATGAATTCATCTAAATCATCT
GAAACACAATGCACAGAGAGAGGATGCTTCTCTTCCCAAATGTTCTTATGGACTGTTGCTGGG
ATCCCCATCCTATTTCTCAGTGCCTGTTTCATCACCAGATGTGTTGTGACATTTCGCATCTTT
CAAACCTGTGATGAGAAAAAGTTTCAGCTACCTGAGAATTTCACAGAGCTCTCCTGCTACAAT
TATGGATCAGGTTCAGTCAAGAATTGTTGTCCATTGAACTGGGAATATTTTCAATCCAGCTGC
TACTTCTTTTCTACTGACACCATTTCCTGGGCGTTAAGTTTAAAGAACTGCTCAGCCATGGGG
GCTCACCTGGTGGTTATCAACTCACAGGAGGAGCAGGAATTCCTTTCCTACAAGAAACCTAAA
ATGAGAGAGTTTTTTATTGGACTGTCAGACCAGGTTGTCGAGGGTCAGTGGCAATGGGTGGAC
GGCACACCTTTGACAAAGTCTCTGAGCTTCTGGGATGTAGGGGAGCCCAACAACATAGCTACC
CTGGAGGACTGTGCCACCATGAGAGACTCTTCAAACCCAAGGCAAAATTGGAATGATGTAACC
TGTTTCCTCAATTATTTTCGGATTTGTGAAATGGTAGGAATAAATCCTTTGAACAAAGGAAAA
TCTCTTTAAGAACAGAAGGCACAACTCAAATGTGTAAAGAAGGAAGAGCAAGAACATGGCCAC
ACCCACCGCCCCACACGAGAAATTTGTGCGCTGAACTTCAAAGGACTTCATAAGTATTTGTTA
CTCTGATACAAATAAAAATAAGTAGTTTTAAATGTTAAAAAAAAAAAAAAAAAAAAAAAAAAA
AAAAAAAAAAAAAAAAAAAAAAAAAAAAAAAAAAAAAAAAAAAAAAAAAAAA

FIGURE 24

MNSSKSSETQCTERGCFSSQMFLWTVAGIPILFLSACFITRCVVTFRIFQTCDEKKFQLPENF
TELSCYNYGSGSVKNCCPLNWEYFQSSCYFFSTDTISWALSLKNCSAMGAHLVVINSQEEQEF
LSYKKPKMREFFIGLSDQVVEGQWQWVDGTPLTKSLSFWDVGEPNNIATLEDCATMRDSSNPR
QNWNDVTCFLNYFRICEMVGINPLNKGKSL

Signal sequence:
amino acids 1-42

N-glycosylation site.
amino acids 2-6, 62-66, 107-111

Casein kinase II phosphorylation site.
amino acids 51-55, 120-124, 163-167, 175-179, 181-185

N-myristoylation site.
amino acids 15-21, 74-80, 155-161

Prokaryotic membrane lipoprotein lipid attachment site.
amino acids 27-38

FIGURE 25

GGGGACGCGGAGCTGAGAGGCTCCGGGCTAGCTAGGTGTAGGGGTGGACGGGTCCCAGGACCC
TGGTGAGGGTTCTCTACTTGGCCTTCGGTGGGGTCAAGACGCAGGCACCTACGCCAAAGGGG
AGCAAAGCCGGGCTCGGCCCGAGGCCCCCAGGACCTCCATCTCCCAATGTTGGAGGAATCCGA
CACGTGACGGTCTGTCCGCCGTCTCAGACTAGAGGAGCGCTGTAAACGCCATGGCTCCCAAGA
AGCTGTCCTGCCTTCGTTCCCTGCTGCTGCCGCTCAGCCTGACGCTACTGCTGCCCCAGGCAG
ACACTCGGTCGTTCGTAGTGGATAGGGGTCATGACCGGTTTCTCCTAGACGGGGCCCCGTTCC
GCTATGTGTCTGGCAGCCTGCACTACTTTCGGGTACCGCGGGTGCTTTGGGCCGACCGGCTTT
TGAAGATGCGATGGAGCGGCCTCAACGCCATACAGTTTTATGTGCCCTGGAACTACCACGAGC
CACAGCCTGGGGTCTATAACTTTAATGGCAGCCGGGACCTCATTGCCTTTCTGAATGAGGCAG
CTCTAGCGAACCTGTTGGTCATACTGAGACCAGGACCTTACATCTGTGCAGAGTGGGAGATGG
GGGGTCTCCCATCCTGGTTGCTTCGAAAACCTGAAATTCATCTAAGAACCTCAGATCCAGACT
TCCTTGCCGCAGTGGACTCCTGGTTCAAGGTCTTGCTGCCCAAGATATATCCATGGCTTTATC
ACAATGGGGGCAACATCATTAGCATTCAGGTGGAGAATGAATATGGTAGCTACAGAGCCTGTG
ACTTCAGCTACATGAGGCACTTGGCTGGGCTCTTCCGTGCACTGCTAGGAGAAAAGATCTTGC
TCTTCACCACAGATGGGCCTGAAGGACTCAAGTGTGGCTCCCTCCGGGGACTCTATACCACTG
TAGATTTTGGCCCAGCTGACAACATGACCAAAATCTTTACCCTGCTTCGGAAGTATGAACCCC
ATGGGCCATTGGTAAACTCTGAGTACTACACAGGCTGGCTGGATTACTGGGGCCAGAATCACT
CCACACGGTCTGTGTCAGCTGTAACCAAAGGACTAGAGAACATGCTCAAGTTGGGAGCCAGTG
TGAACATGTACATGTTCCATGGAGGTACCAACTTTGGATATTGGAATGGTGCCGATAAGAAGG
GACGCTTCCTTCCGATTACTACCAGCTATGACTATGATGCACCTATATCTGAAGCAGGGGACC
CCACACCTAAGCTTTTTGCTCTTCGAGATGTCATCAGCAAGTTCCAGGAAGTTCCTTTGGGAC
CTTTACCTCCCCCGAGCCCCAAGATGATGCTTGGACCTGTGACTCTGCACCTGGTTGGGCATT
TACTGGCTTTCCTAGACTTGCTTTGCCCCCGTGGGCCCATTCATTCAATCTTGCCAATGACCT
TTGAGGCTGTCAAGCAGGACCATGGCTTCATGTTGTACCGAACCTATATGACCCATACCATTT
TTGAGCCAACACCATTCTGGGTGCCAAATAATGGAGTCCATGACCGTGCCTATGTGATGGTGG
ATGGGGTGTTCCAGGGTGTTGTGGAGCGAAATATGAGAGACAAACTATTTTTGACGGGGAAAC
TGGGGTCCAAACTGGATATCTTGGTGGAGAACATGGGGAGGCTCAGCTTTGGGTCTAACAGCA
GTGACTTCAAGGGCCTGTTGAAGCCACCAATTCTGGGGCAAACAATCCTTACCCAGTGGATGA
TGTTCCCTCTGAAAATTGATAACCTTGTGAAGTGGTGGTTTCCCCTCCAGTTGCCAAAATGGC
CATATCCTCAAGCTCCTTCTGGCCCCACATTCTACTCCAAAACATTTCCAATTTTAGGCTCAG
TTGGGGACACATTTCTATATCTACCTGGATGGACCAAGGGCCAAGTCTGGATCAATGGGTTTA
ACTTGGGCCGGTACTGGACAAAGCAGGGGCCACAACAGACCCTCTACGTGCCAAGATTCCTGC
TGTTTCCTAGGGGAGCCCTCAACAAAATTACATTGCTGGAACTAGAAGATGTACCTCTCCAGC
CCCAAGTCCAATTTTTGGATAAGCCTATCCTCAATAGCACTAGTACTTTGCACAGGACACATA
TCAATTCCCTTTCAGCTGATACACTGAGTGCCTCTGAACCAATGGAGTTAAGTGGGCACTGAA
AGGTAGGCCGGGCATGGTGGCTCATGCCTGTAATCCCAGCACTTTGGGAGGCTGAGACGGGTG
GATTACCTGAGGTCAGGACTTCAAGACCAGCCTGGCCAACATGGTGAAACCCCGTCTCCACTA
AAAATACAAAAATTAGCCGGGCGTGATGGTGGGCACCTCTAATCCCAGCTACTTGGAGGCTG
AGGGCAGGAGAATTGCTTGAATCCAGGAGGCAGAGGTTGCAGTGAGTGGAGGTTGTACCACTG
CACTCCAGCCTGGCTGACAGTGAGACACTCCATCTCAAAAAAAAAAAA

FIGURE 26

MAPKKLSCLRSLLLPLSLTLLLPQADTRSFVVDRGHDRFLLDGAPFRYVSGSLHYFRVPRVLW
ADRLLKMRWSGLNAIQFYVPWNYHEPQPGVYNFNGSRDLIAFLNEAALANLLVILRPGPYICA
EWEMGGLPSWLLRKPEIHLRTSDPDFLAAVDSWFKVLLPKIYPWLYHNGGNIISIQVENEYGS
YRACDFSYMRHLAGLFRALLGEKILLFTTDGPEGLKCGSLRGLYTTVDFGPADNMTKIFTLLR
KYEPHGPLVNSEYYTGWLDYWGQNHSTRSVSAVTKGLENMLKLGASVNMYMFHGGTNFGYWNG
ADKKGRFLPITTSYDYDAPISEAGDPTPKLFALRDVISKFQEVPLGPLPPPSPKMMLGPVTLH
LVGHLLAFLDLLCPRGPIHSILPMTFEAVKQDHGFMLYRTYMTHTIFEPTPFWVPNNGVHDRA
YVMVDGVFQGVVERNMRDKLFLTGKLGSKLDILVENMGRLSFGSNSSDFKGLLKPPILGQTIL
TQWMMFPLKIDNLVKWWFPLQLPKWPYPQAPSGPTFYSKTFPILGSVGDTFLYLPGWTKGQVW
INGFNLGRYWTKQGPQQTLYVPRFLLFPRGALNKITLLELEDVPLQPQVQFLDKPILNSTSTL
HRTHINSLSADTLSASEPMELSGH

Signal sequence:
amino acids 1-27

N-glycosylation site.
amino acids 97-101, 243-247, 276-280, 486-490, 625-629 cAMP- and cGMP-dependent protein kinase phosphorylation site.
amino acids 4-8

Casein kinase II phosphorylation site.
amino acids 148-152, 234-238, 327-331, 423-427, 469-473, 550-554, 603-607, 644-648

Tyrosine kinase phosphorylation site.
amino acids 191-198

N-myristoylation site.
amino acids 131-137, 176-182, 188-194, 203-209, 223-229, 227-233, 231-237, 274-280, 296-300, 307-313, 447-453, 484-490

FIGURE 27

GGACAGCTCGCGGCCCCCGAGAGCTCTAGCCGTCGAGGAGCTGCCTGGGGACGTTTGCCCTGG
GGCCCCAGCCTGGCCCGGGTCACCCTGGCATGAGGAGATGGGCCTGTTGCTCCTGGTCCCATT
GCTCCTGCTGCCCGGCTCCTACGGACTGCCCTTCTACAACGGCTTCTACTACTCCAACAGCGC
CAACGACCAGAACCTAGGCAACGGTCATGGCAAAGACCTCCTTAATGGAGTGAAGCTGGTGGT
GGAGACACCCGAGGAGACCCTGTTCACCTACCAAGGGGCCAGTGTGATCCTGCCCTGCCGCTA
CCGCTACGAGCCGGCCCTGGTCTCCCCGCGGCGTGTGCGTGTCAAATGGTGGAAGCTGTCGGA
GAACGGGGCCCCAGAGAAGGACGTGCTGGTGGCCATCGGGCTGAGGCACCGCTCCTTTGGGGA
CTACCAAGGCCGCGTGCACCTGCGGCAGGACAAAGAGCATGACGTCTCGCTGGAGATCCAGGA
TCTGCGGCTGGAGGACTATGGGCGTTACCGCTGTGAGGTCATTGACGGGCTGGAGGATGAAAG
CGGTCTGGTGGAGCTGGAGCTGCGGGGTGTGGTCTTTCCTTACCAGTCCCCCAACGGGCGCTA
CCAGTTCAACTTCCACGAGGGCCAGCAGGTCTGTGCAGAGCAGGCTGCGGTGGTGGCCTCCTT
TGAGCAGCTCTTCCGGGCCTGGGAGGAGGGCCTGGACTGGTGCAACGCGGGCTGGCTGCAGGA
TGCTACGGTGCAGTACCCCATCATGTTGCCCCGGCAGCCCTGCGGTGGCCCAGGCCTGGCACC
TGGCGTGCGAAGCTACGGCCCCCGCCACCGCCGCCTGCACCGCTATGATGTATTCTGCTTCGC
TACTGCCCTCAAGGGGCGGGTGTACTACCTGGAGCACCCTGAGAAGCTGACGCTGACAGAGGC
AAGGGAGGCCTGCCAGGAAGATGATGCCACGATCGCCAAGGTGGGACAGCTCTTTGCCGCCTG
GAAGTTCCATGGCCTGGACCGCTGCGACGCTGGCTGGCTGGCAGATGGCAGCGTCCGCTACCC
TGTGGTTCACCCGCATCCTAACTGTGGGCCCCCAGAGCCTGGGGTCCGAAGCTTTGGCTTCCC
CGACCCGCAGAGCCGCTTGTACGGTGTTTACTGCTACCGCCAGCACTAGGACCTGGGGCCCTC
CCCTGCCGCATTCCCTCACTGGCTGTGTATTTATTGAGTGGTTCGTTTTCCCTTGTGGGTTGG
AGCCATTTTAACTGTTTTTATACTTCTCAATTTAAATTTTCTTTAAACATTTTTTTACTATTT
TTTGTAAAGCAAACAGAACCCAATGCCTCCCTTTGCTCCTGGATGCCCCACTCCAGGAATCAT
GCTTGCTCCCCTGGGCCATTTGCGGTTTTGTGGGCTTCTGGAGGGTTCCCCGCCATCCAGGCT
GGTCTCCCTCCCTTAAGGAGGTTGGTGCCCAGAGTGGGCGGTGGCCTGTCTAGAATGCCGCCG
GGAGTCCGGGCATGGTGGCACAGTTCTCCCTGCCCCTCAGCCTGGGGGAAGAAGAGGGCCTC
GGGGGCCTCCGGAGCTGGGCTTTGGGCCTCTCCTGCCCACCTCTACTTCTCTGTGAAGCCGCT
GACCCCAGTCTGCCCACTGAGGGGCTAGGGCTGGAAGCCAGTTCTAGGCTTCCAGGCGAAATC
TGAGGGAAGGAAGAAACTCCCCTCCCCGTTCCCCTTCCCCTCTCGGTTCCAAAGAATCTGTTT
TGTTGTCATTTGTTTCTCCTGTTTCCCTGTGTGGGGAGGGGCCCTCAGGTGTGTGTACTTTGG
ACAATAAATGGTGCTATGACTGCCTTCCGCCAAAAAAAAAAAAAAAAAAAAAAAAAAAAA
AAAAAAAAAAAAAAAAAAAAAAAAAAAAAAAAAAAAAAAAAAAAAAAAAAAAAAAAAAAA
AAAAAAAAAAAAAAAAAAAAAAAAAAAAAA

FIGURE 28

MGLLLLVPLLLLPGSYGLPFYNGFYYSNSANDQNLGNGHGKDLLNGVKLVVETPEETLFTYQG
ASVILPCRYRYEPALVSPRRVRVKWWKLSENGAPEKDVLVAIGLRHRSFGDYQGRVHLRQDKE
HDVSLEIQDLRLEDYGRYRCEVIDGLEDESGLVELELRGVVFPYQSPNGRYQFNFHEGQQVCA
EQAAVVASFEQLFRAWEEGLDWCNAGWLQDATVQYPIMLPRQPCGGPGLAPGVRSYGPRHRRL
HRYDVFCFATALKGRVYYLEHPEKLTLTEAREACQEDDATIAKVGQLFAAWKFHGLDRCDAGW
LADGSVRYPVVHPHPNCGPPEPGVRSFGFPDPQSRLYGVYCYRQH

Signal sequence:
amino acids 1-17

Casein kinase II phosphorylation site.
amino acids 29-33, 53-57, 111-115, 278-282

Tyrosine kinase phosphorylation site.
amino acids 137-145

N-myristoylation site.
aminoacids 36-42, 184-190, 208-214, 237-243, 297-303, 307-313

FIGURE 29

GCAAGCGGCGAAATGGCGCCCTCCGGGAGTCTTGCAGTTCCCCTGGCAGTCCTGGTGCTGTTG
CTTTGGGGTGCTCCCTGGACGCACGGGCGGCGGAGCAACGTTCGCGTCATCACGGACGAGAAC
TGGAGAGAACTGCTGGAAGGAGACTGGATGATAGAATTTTATGCCCCGTGGTGCCCTGCTTGT
CAAAATCTTCAACCGGAATGGGAAAGTTTTGCTGAATGGGGAGAAGATCTTGAGGTTAATATT
GCGAAAGTAGATGTCACAGAGCAGCCAGGACTGAGTGGACGGTTTATCATAACTGCTCTTCCT
ACTATTTATCATTGTAAAGATGGTGAATTTAGGCGCTATCAGGGTCCAAGGACTAAGAAGGAC
TTCATAAACTTTATAAGTGATAAAGAGTGGAAGAGTATTGAGCCCGTTTCATCATGGTTTGGT
CCAGGTTCTGTTCTGATGAGTAGTATGTCAGCACTCTTTCAGCTATCTATGTGGATCAGGACG
TGCCATAACTACTTTATTGAAGACCTTGGATTGCCAGTGTGGGGATCATATACTGTTTTTGCT
TTAGCAACTCTGTTTTCCGGACTGTTATTAGGACTCTGTATGATATTTGTGGCAGATTGCCTT
TGTCCTTCAAAAAGGCGCAGACCACAGCCATACCCATACCCTTCAAAAAAATTATTATCAGAA
TCTGCACAACCTTTGAAAAAAGTGGAGGAGGAACAAGAGGCGGATGAAGAAGATGTTTCAGAA
GAAGAAGCTGAAAGTAAAGAAGGAACAAACAAAGACTTTCCACAGAATGCCATAAGACAACGC
TCTCTGGGTCCATCATTGGCCACAGATAAATCCTAGTTAAATTTTATAGTTATCTTAATATTA
TGATTTTGATAAAAACAGAAGATTGATCATTTTGTTTGGTTTGAAGTGAACTGTGACTTTTTT
GAATATTGCAGGGTTCAGTCTAGATTGTCATTAAATTGAAGAGTCTACATTCAGAACATAAAA
GCACTAGGTATACAAGTTTGAAATATGATTTAAGCACAGTATGATGGTTTAAATAGTTCTCTA
ATTTTTGAAAAATCGTGCCAAGCAATAAGATTTATGTATATTTGTTTAATAATAACCTATTTC
AAGTCTGAGTTTTGAAAATTTACATTTCCCAAGTATTGCATTATTGAGGTATTTAAGAAGATT
ATTTTAGAGAAAAATATTTCTCATTTGATATAATTTTTCTCTGTTTCACTGTGTGAAAAAAAG
AAGATATTTCCCATAAATGGGAAGTTTGCCCATTGTCTCAAGAAATGTGTATTTCAGTGACAA
TTTCGTGGTCTTTTTAGAGGTATATTCCAAAATTTCCTTGTATTTTTAGGTTATGCAACTAAT
AAAAACTACCTTACATTAATTAATTACAGTTTTCTACACATGGTAATACAGGATATGCTACTG
ATTTAGGAAGTTTTTAAGTTCATGGTATTCTCTTGATTCCAACAAAGTTTGATTTTCTCTTGT
ATTTTTCTTACTTACTATGGGTTACATTTTTTATTTTTCAAATTGGATGATAATTTCTTGGAA
ACATTTTTTATGTTTTAGTAAACAGTATTTTTTTGTTGTTTCAAACTGAAGTTTACTGAGAGA
TCCATCAAATTGAACAATCTGTTGTAATTTAAAATTTTGGCCACTTTTTTCAGATTTTACATC
ATTCTTGCTGAACTTCAACTTGAAATTGTTTTTTTTTTCTTTTTGGATGTGAAGGTGAACATT
CCTGATTTTTGTCTGATGTGAAAAAGCCTTGGTATTTTACATTTTGAAAATTCAAAGAAGCTT
AATATAAAAGTTTGCATTCTACTCAGGAAAAAGCATCTTCTTGTATATGTCTTAAATGTATTT
TTGTCCTCATATACAGAAAGTTCTTAATTGATTTTACAGTCTGTAATGCTTGATGTTTTAAAA
TAATAACATTTTTATATTTTTTAAAAGACAAACTTCATATTATCCTGTGTTCTTTCCTGACTG
GTAATATTGTGTGGGATTTCACAGGTAAAAGTCAGTAGGATGGAACATTTTAGTGTATTTTTA
CTCCTTAAAGAGCTAGAATACATAGTTTTCACCTTAAAAGAAGGGGGAAAATCATAAATACAA
TGAATCAACTGACCATTACGTAGTAGACAATTTCTGTAATGTCCCCTTCTTTCTAGGCTCTGT
TGCTGTGTGAATCCATTAGATTTACAGTATCGTAATATACAAGTTTTCTTTAAAGCCCTCTCC
TTTAGAATTTAAAATATTGTACCATTAAAGAGTTTGGATGTGTAACTTGTGATGCCTTAGAAA
AATATCCTAAGCACAAAATAAACCTTTCTAACCACTTCATTAAAGCTGAAAAAAAAAAAAAAA
AAA

FIGURE 30

MAPSGSLAVPLAVLVLLLWGAPWTHGRRSNVRVITDENWRELLEGDWMIEFYAPWCPACQNLQ
PEWESFAEWGEDLEVNIAKVDVTEQPGLSGRFIITALPTIYHCKDGEFRRYQGPRTKKDFINF
ISDKEWKSIEPVSSWFGPGSVLMSSMSALFQLSMWIRTCHNYFIEDLGLPVWGSYTVFALATL
FSGLLLGLCMIFVADCLCPSKRRRPQPYPYPSKKLLSESAQPLKKVEEEQEADEEDVSEEEAE
SKEGTNKDFPQNAIRQRSLGPSLATDKS

Signal sequence:
amino acids 1-26

Transmembrane domain:
amino acids 182-201

Casein kinase II phosphorylation site.
amino acids 68-72, 119-123, 128-132, 247-251, 257-261

Tyrosine kinase phosphorylation site.
amino acids 107-115

N-myristoylation site.
amino acids 20-26, 192-198

Amidation site.
amino acids 25-29

FIGURE 31

AGATGGCGGTCTTGGCACCTCTAATTGCTCTCGTGTATTCGGTGCCGCGACTTTCACGATGGC
TCGCCCAACCTTACTACCTTCTGTCGGCCCTGCTCTCTGCTGCCTTCCTACTCGTGAGGAAAC
TGCCGCCGCTCTGCCACGGTCTGCCCACCCAACGCGAAGACGGTAACCCGTGTGACTTTGACT
GGAGAGAAGTGGAGATCCTGATGTTTCTCAGTGCCATTGTGATGATGAAGAACCGCAGATCCA
TCACTGTGGAGCAACATATAGGCAACATTTTCATGTTTAGTAAAGTGGCCAACACAATTCTTT
TCTTCCGCTTGGATATTCGCATGGCCTACTTTACATCACACTCTGCATAGTGTTCCTGATGA
CGTGCAAACCCCCCCTATATATGGGCCCTGAGTATATCAAGTACTTCAATGATAAAACCATTG
ATGAGGAACTAGAACGGGACAAGAGGGTCACTTGGATTGTGGAGTTCTTTGCCAATTGGTCTA
ATGACTGCCAATCATTTGCCCCTATCTATGCTGACCTCTCCCTTAAATACAACTGTACAGGGC
TAAATTTTGGGAAGGTGGATGTTGGACGCTATACTGATGTTAGTACGCGGTACAAAGTGAGCA
CATCACCCCTCACCAAGCAACTCCCTACCCTGATCCTGTTCCAAGGTGGCAAGGAGGCAATGC
GGCGGCCACAGATTGACAAGAAAGGACGGGCTGTCTCATGGACCTTCTCTGAGGAGAATGTGA
TCCGAGAATTTAACTTAAATGAGCTATACCAGCGGGCCAAGAAACTATCAAAGGCTGGAGACA
ATATCCCTGAGGAGCAGCCTGTGGCTTCAACCCCCACCACAGTGTCAGATGGGGAAAACAAGA
AGGATAAATAAGATCCTCACTTTGGCAGTGCTTCCTCTCCTGTCAATTCCAGGCTCTTTCCAT
AACCACAAGCCTGAGGCTGCAGCCTTTNATTNATGTTTTCCCTTTGGCTGNGACTGGNTGGGG
CAGCATGCAGCTTCTGATTTTAAAGAGGCATCTAGGGAATTGTCAGGCACCCTACAGGAAGGC
CTGCCATGCTGTGGCCAACTGTTTCACTGGAGCAAGAAAGAGATCTCATAGGACGGAGGGGGA
AATGGTTTCCCTCCAAGCTTGGGTCAGTGTGTTAACTGCTTATCAGCTATTCAGACATCTCCA
TGGTTTCTCCATGAAACTCTGTGGTTTCATCATTCCTTCTTAGTTGACCTGCACAGCTTGGTT
AGACCTAGATTTAACCCTAAGGTAAGATGCTGGGGTATAGAACGCTAAGAATTTTCCCCCAAG
GACTCTTGCTTCCTTAAGCCCTTCTGGCTTCGTTTATGGTCTTCATTAAAAGTATAAGCCTAA
CTTTGTCGCTAGTCCTAAGGAGAAACCTTTAACCACAAAGTTTTTATCATTGAAGACAATATT
GAACAACCCCCTATTTTGTGGGGATTGAGAAGGGGTGAATAGAGGCTTGAGACTTTCCTTTGT
GTGGTAGGACTTGGAGGAGAAATCCCCTGGACTTTCACTAACCCTCTGACATACTCCCCACAC
CCAGTTGATGGCTTTCCGTAATAAAAAGATTGGGATTTCCTTTTG

FIGURE 32

MAVLAPLIALVYSVPRLSRWLAQPYYLLSALLSAAFLLVRKLPPLCHGLPTQREDGNPCDFDW
REVEILMFLSAIVMMKNRRSITVEQHIGNIFMFSKVANTILFFRLDIRMGLLYITLCIVFLMT
CKPPLYMGPEYIKYFNDKTIDEELERDKRVTWIVEFFANWSNDCQSFAPIYADLSLKYNCTGL
NFGKVDVGRYTDVSTRYKVSTSPLTKQLPTLILFQGGKEAMRRPQIDKKGRAVSWTFSEENVI
REFNLNELYQRAKKLSKAGDNIPEEQPVASTPTTVSDGENKKDK

Signal sequence:
amino acids 1-48

Transmembrane domain:
amino acids 111-125

N-glycosylation site.
amino acids 165-169, 185-189 cAMP- and cGMP-dependent protein kinase phosphorylation site.
amino acids 154-158, 265-269

Casein kinase II phosphorylation site.
amino acids 51-55, 145-149, 245-249, 286-290, 288-292

N-myristoylation site.
amino acids 188-194, 225-231

Myb DNA-binding domain repeat signature 1.
amino acids 244-253

FIGURE 33

CGGACGCGTGGGGTGCCCGACATGGCGAGTGTAGTGCTGCCGAGCGGATCCCAGTGTGCGGCG
GCAGCGGCGGCGGCGGCGCCTCCCGGGCTCCGGCTTCTGCTGTTGCTCTTCTCCGCCGCGGCA
CTGATCCCCACAGGTGATGGGCAGAATCTGTTTACGAAAGACGTGACAGTGATCGAGGGAGAG
GTTGCGACCATCAGTTGCCAAGTCAATAAGAGTGACGACTCTGTGATTCAGCTACTGAATCCC
AACAGGCAGACCATTTATTTCAGGGACTTCAGGCCTTTGAAGGACAGCAGGTTTCAGTTGCTG
AATTTTTCTAGCAGTGAACTCAAAGTATCATTGACAAACGTCTCAATTTCTGATGAAGGAAGA
TACTTTTGCCAGCTCTATACCGATCCCCCACAGGAAAGTTACACCACCATCACAGTCCTGGTC
CCACCACGTAATCTGATGATCGATATCCAGAAAGACACTGCGGTGGAAGGTGAGGAGATTGAA
GTCAACTGCACTGCTATGGCCAGCAAGCCAGCCACGACTATCAGGTGGTTCAAAGGGAACACA
GAGCTAAAAGGCAAATCGGAGGTGGAAGAGTGGTCAGACATGTACACTGTGACCAGTCAGCTG
ATGCTGAAGGTGCACAAGGAGGACGATGGGGTCCCAGTGATCTGCCAGGTGGAGCACCCTGCG
GTCACTGGAAACCTGCAGACCCAGCGGTATCTAGAAGTACAGTATAAGCCTCAAGTGCACATT
CAGATGACTTATCCTCTACAAGGCTTAACCCGGGAAGGGGACGCGCTTGAGTTAACATGTGAA
GCCATCGGGAAGCCCCAGCCTGTGATGGTAACTTGGGTGAGAGTCGATGATGAAATGCCTCAA
CACGCCGTACTGTCTGGGCCCAACCTGTTCATCAATAACCTAAACAAAACAGATAATGGTACA
TACCGCTGTGAAGCTTCAAACATAGTGGGGAAAGCTCACTCGGATTATATGCTGTATGTATAC
GATCCCCCCACAACTATCCCTCCTCCCACAACAACCACCACCACCACCACCACCACCACCACC
ACCATCCTTACCATCATCACAGATTCCCGAGCAGGTGAAGAAGGCTCGATCAGGGCAGTGGAT
CATGCCGTGATCGGTGGCGTCGTGGCGGTGGTGGTGTTCGCCATGCTGTGCTTGCTCATCATT
CTGGGGCGCTATTTTGCCAGACATAAAGGTACATACTTCACTCATGAAGCCAAAGGAGCCGAT
GACGCAGCAGACGCAGACACAGCTATAATCAATGCAGAAGGAGGACAGAACAACTCCGAAGAA
AAGAAAGAGTACTTCATCTAGATCAGCCTTTTTGTTTCAATGAGGTGTCCAACTGGCCCTATT
TAGATGATAAAGAGACAGTGATATTGG

FIGURE 34

</usr/seqdb2/sst/DNA/Dnaseqs.min/ss.DNA39518
<subunit 1 of 1, 440 aa, 1 stop
<MW: 48240, pI: 4.93, NX(S/T): 7
MASVVLPSGSQCAAAAAAAAPPGLRLLLLLFSAAALIPTGDGQNLFTKDVTVIEGEVATISCQ
VNKSDDSVIQLLNPNRQTIYFRDFRPLKDSRFQLLNFSSSELKVSLTNVSISDEGRYFCQLYT
DPPQESYTTITVLVPPRNLMIDIQKDTAVEGEEIEVNCTAMASKPATTIRWFKGNTELKGKSE
VEEWSDMYTVTSQLMLKVHKEDDGVPVICQVEHPAVTGNLQTQRYLEVQYKPQVHIQMTYPLQ
GLTREGDALELTCEAIGKPQPVMVTWVRVDDEMPQHAVLSGPNLFINNLNKTDNGTYRCEASN
IVGKAHSDYMLYVYDPPTTIPPPTTTTTTTTTTTTILTIITDSRAGEEGSIRAVDHAVIGGV
VAVVVFAMLCLLIILGRYFARHKGTYFTHEAKGADDAADADTAIINAEGGQNNSEEKKEYFI

Signal sequence.
amino acids 1-36

Transmembrane domain.
amino acids 372-393

N-glycosylation sites.
amino acids 65-69, 99-103, 111-115, 163-167, 302-306, 306-310, 430-434

Tyrosine kinase phosphorylation sites.
amino acids 233-240, 319-328

N-myristoylation sites.
amino acids 9-15, 227-233, 307-313, 365-371, 376-382, 402-408, 411-417, 427-433, 428-432

FIGURE 35

GGTTGCCACAGCTGGTTTAGGGCCCCGACCACTGGGGCCCCTTGTCAGGAGGAGACAGCCTCCCGGCCCGGGGAG
GACAAGTCGCTGCCACCTTTGGCTGCCGACGTGATTCCCTGGGACGGTCCGTTTCCTGCCGTCAGCTGCCGGCCG
AGTTGGGTCTCCGTGTTTCAGGCCGGCTCCCCCTTCCTGGTCTCCCTTCTCCCGCTGGGCCGGTTTATCGGGAGG
AGATTGTCTTCCAGGGCTAGCAATTGGACTTTTGATGATGTTTGACCCAGCGGCAGGAATAGCAGGCAACGTGAT
TTCAAAGCTGGGCTCAGCCTCTGTTTCTTCTCTCGTGTAATCGCAAAACCCATTTTGGAGCAGGAATTCCAATCA
TGTCTGTGATGGTGGTGAGAAAGAAGGTGACACGGAAATGGGAGAAACTCCCAGGCAGGAACACCTTTTGCTGTG
ATGGCCGCGTCATGATGGCCCGGCAAAAGGGCATTTTCTACCTGACCCTTTTCCTCATCCTGGGGACATGTACAC
TCTTCTTCGCCTTTGAGTGCCGCTACCTGGCTGTTCAGCTGTCTCCTGCCATCCCTGTATTTGCTGCCATGCTCT
TCCTTTTCTCCATGGCTACACTGTTGAGGACCAGCTTCAGTGACCCTGGAGTGATTCCTCGGGCGCTACCAGATG
AAGCAGCTTTCATAGAAATGGAGATAGAAGCTACCAATGGTGCGGTGCCCCAGGGCCAGCGACCACCGCCTCGTA
TCAAGAATTTCCAGATAAACAACCAGATTGTGAAACTGAAATACTGTTACACATGCAAGATCTTCCGGCCTCCCC
GGGCCTCCCATTGCAGCATCTGTGACAACTGTGTGGAGCGCTTCGACCATCACTGCCCCTGGGTGGGGAATTGTG
TTGGAAAGAGGAACTACCGCTACTTCTACCTCTTCATCCTTTCTCTCTCCCTCCTCACAATCTATGTCTTCGCCT
TCAACATCGTCTATGTGGCCCTCAAATCTTTGAAAATTGGCTTCTTGGAGACATTGAAAGAAACTCCTGGAACTG
TTCTAGAAGTCCTCATTTGCTTCTTTACACTCTGGTCCGTCGTGGGACTGACTGGATTTCATACTTTCCTCGTGG
CTCTCAACCAGACAACCAATGAAGACATCAAAGGATCATGGACAGGGAAGAATCGCGTCCAGAATCCCTACAGCC
ATGGCAATATTGTGAAGAACTGCTGTGAAGTGCTGTGTGGCCCCTTGCCCCCCAGTGTGCTGGATCGAAGGGGTA
TTTTGCCACTGGAGGAAAGTGGAAGTCGACCTCCCAGTACTCAAGAGACCAGTAGCAGCCTCTTGCCACAGAGCC
CAGCCCCCACAGAACACCTGAACTCAAATGAGATGCCGGAGGACAGCAGCACTCCCGAAGAGATGCCACCTCCAG
AGCCCCCAGAGCCACCACAGGAGGCAGCTGAAGCTGAGAAGTAGCCTATCTATGGAAGAGACTTTTGTTTGTGTT
TAATTAGGGCTATGAGAGATTTCAGGTGAGAAGTTAAACCTGAGACAGAGAGCAAGTAAGCTGTCCCTTTTAACT
GTTTTTCTTTGGTCTTTAGTCACCCAGTTGCACACTGGCATTTTCTTGCTGCAAGCTTTTTTAAATTTCTGAACT
CAAGGCAGTGGCAGAAGATGTCAGTCACCTCTGATAACTGGAAAAATGGGTCTCTTGGGCCCTGGCACTGGTTCT
CCATGGCCTCAGCCACAGGGTCCCCTTGGACCCCCTCTCTTCCCTCCAGATCCCAGCCCTCCTGCTTGGGGTCAC
TGGTCTCATTCTGGGGCTAAAAGTTTTTGAGACTGGCTCAAATCCTCCCAAGCTGCTGCACGTGCTGAGTCCAGA
GGCAGTCACAGAGACCTCTGGCCAGGGGATCCTAACTGGGTTCTTGGGGTCTTCAGGACTGAAGAGGAGGGAGAG
TGGGGTCAGAAGATTCTCCTGGCCACCAAGTGCCAGCATTGCCCACAAATCCTTTTAGGAATGGACAGGTACCT
TCCACTTGTTGTANNNNNNNNNNNNNNNNNNNNNNNNNNNTTGTTTTTCCTTTTGACTCCTGCTCCCATTAGGAG
CAGGAATGGCAGTAATAAAGTCTGCACTTTGGTCATTTCTTTTCCTCAGAGGAAGCCCGAGTGCTCACTTAAAC
ACTATCCCCTCAGACTCCCTGTGTGAGGCCTGCAGAGGCCCTGAATGCACAAATGGGAAACCAAGGCACAGAGAG
GCTCTCCTCTCCTCTCCTCTCCCCCGATGTACCCTCAAAAAAAAAAAAAATGCTAACCAGTTCTTCCATTAAGCCT
CGGCTGAGTGAGGGAAAGCCCAGCACTGCTGCCCTCTCGGGTAACTCACCCTAAGGCCTCGGCCCACCTCTGGCT
ATGGTAACCACACTGGGGGCTTCCTCCAAGCCCCGCTCTTCCAGCACTTCCACCGGCAGAGTCCCAGAGCCACTT
CACCCTGGGGGTGGGCTGTGGCCCCCAGTCAGCTCTGCTCAGGACCTGCTCTATTTCAGGGAAGAAGATTTATGT
ATTATATGTGGCTATATTTCCTAGAGCACCTGTGTTTTCCTCTTTCTAAGCCAGGGTCCTGTCTGGATGACTTAT
GCGGTGGGGGAGTGTAAACCGGAACTTTTCATCTATTTGAAGGCGATTAAACTGTGTCTAATGCA

FIGURE 36

MSVMVVRKKVTRKWEKLPGRNTFCCDGRVMMARQKGIFYLTLFLILGTCTLFFAFECRYLAVQ
LSPAIPVFAAMLFLFSMATLLRTSFSDPGVIPRALPDEAAFIEMEIEATNGAVPQGQRPPPRI
KNFQINNQIVKLKYCYTCKIFRPPRASHCSICDNCVERFDHHCPWVGNCVGKRNYRYFYLFIL
SLSLLTIYVFAFNIVYVALKSLKIGFLETLKETPGTVLEVLICFFTLWSVVGLTGFHTFLVAL
NQTTNEDIKGSWTGKNRVQNPYSHGNIVKNCCEVLCGPLPPSVLDRRGILPLEESGSRPPSTQ
ETSSSLLPQSPAPTEHLNSNEMPEDSSTPEEMPPPEPPEPPQEAAEAEK

Putative transmembrane domains:

amino acids 36-55 (type II TM), 65-84, 188-208, 229-245

FIGURE 37

GGCGGAGCAGCCCTAGCCGCCACCGTCGCTCTCGCAGCTCTCGTCGCCACTGCCACCGCCGCCGCCGTCACTGCG
TCCTGGCTCCGGCTCCCGCGCCCTCCCGGCCGGCCATGCAGCCCCGCCGCGCCCAGGCGCCCGGTGCGCAGCTGC
TGCCCGCGCTGGCCCTGCTGCTGCTGCTGCTCGGAGCGGGGCCCCGAGGCAGCTCCCTGGCCAACCCGGTGCCCG
CCGCGCCCTTGTCTGCGCCCGGGCCGTGCGCCGCGCAGCCCTGCCGGAATGGGGGTGTGTGCACCTCGCGCCCTG
AGCCGGACCCGCAGCACCCGGCCCCCGCCGGCGAGCCTGGCTACAGCTGCACCTGCCCCGCCGGGATCTCCGGCG
CCAACTGCCAGCTTGTTGCAGATCCTTGTGCCAGCAACCCTTGTCACCATGGCAACTGCAGCAGCAGCAGCAGCA
GCAGCAGCGATGGCTACCTCTGCATTTGCAATGAAGGCTATGAAGGTCCCAACTGTGAACAGGCACTTCCCAGTC
TCCCAGCCACTGGCTGGACCGAATCCATGGCACCCCGACAGCTTCAGCCTGTTCCTGCTACTCAGGAGCCTGACA
AAATCCTGCCTCGCTCTCAGGCAACGGTGACACTGCCTACCTGGCAGCCGAAAACAGGGCAGAAAGTTGTAGAAA
TGAAATGGGATCAAGTGGAGGTGATCCCAGATATTGCCTGTGGGAATGCCAGTTCTAACAGCTCTGCGGGTGGCC
GCCTGGTATCCTTTGAAGTGCCACAGAACACCTCAGTCAAGATTCGGCAAGATGCCACTGCCTCACTGATTTTGC
TCTGGAAGGTCACGGCCACAGGATTCCAACAGTGCTCCCTCATAGATGGACGAAGTGTGACCCCCCTTCAGGCTT
CAGGGGGACTGGTCCTCCTGGAGGAGATGCTCGCCTTGGGGAATAATCACTTTATTGGTTTTGTGAATGATTCTG
TGACTAAGTCTATTGTGGCTTTGCGCTTAACTCTGGTGGTGAAGGTCAGCACCTGTGTGCCGGGGGAGAGTCACG
CAAATGACTTGGAGTGTTCAGGAAAAGGAAAATGCACCACGAAGCCGTCAGAGGCAACTTTTTCCTGTACCTGTG
AGGAGCAGTACGTGGGTACTTTCTGTGAAGAATACGATGCTTGCCAGAGGAAACCTTGCCAAAACAACGCGAGCT
GTATTGATGCAAATGAAAAGCAAGATGGGAGCAATTTCACCTGTGTTTGCCTTCCTGGTTATACTGGAGAGCTTT
GCCAGTCCAAGATTGATTACTGCATCCTAGACCCATGCAGAAATGGAGCAACATGCATTTCCAGTCTCAGTGGAT
TCACCTGCCAGTGTCCAGAAGGATACTTCGGATCTGCTTGTGAAGAAAAGGTGGACCCCTGCGCCTCGTCTCCGT
GCCAGAACAACGGCACCTGCTATGTGGACGGGGTACACTTTACCTGCAACTGCAGCCCGGGCTTCACAGGGCCGA
CCTGTGCCCAGCTTATTGACTTCTGTGCCCTCAGCCCCTGTGCTCATGGCACGTGCCGCAGCGTGGGCACCAGCT
ACAAATGCCTCTGTGATCCAGGTTACCATGGCCTCTACTGTGAGGAGGAATATAATGAGTGCCTCTCCGCTCCAT
GCCTGAATGCAGCCACCTGCAGGGACCTCGTTAATGGCTATGAGTGTGTGTGCCTGGCAGAATACAAAGGAACAC
ACTGTGAATTGTACAAGGATCCCTGCGCTAACGTCAGCTGTCTGAACGGAGCCACCTGTGACAGCGACGGCCTGA
ATGGCACGTGCATCTGTGCACCCGGGTTTACAGGTGAAGAGTGCGACATTGACATAAATGAATGTGACAGTAACC
CCTGCCACCATGGTGGGAGCTGCCTGGACCAGCCCAATGGTTATAACTGCCACTGCCCGCATGGTTGGGTGGGAG
CAAACTGTGAGATCCACCTCCAATGGAAGTCCGGGCACATGGCGGAGAGCCTCACCAACATGCCACGGCACTCCC
TCTACATCATCATTGGAGCCCTCTGCGTGGCCTTCATCCTTATGCTGATCATCCTGATCGTGGGGATTTGCCGCA
TCAGCCGCATTGAATACCAGGGTTCTTCCAGGCCAGCCTATGAGGAGTTCTACAACTGCCGCAGCATCGACAGCG
AGTTCAGCAATGCCATTGCATCCATCCGGCATGCCAGGTTTGGAAAGAAATCCCGGCCTGCAATGTATGATGTGA
GCCCCATCGCCTATGAAGATTACAGTCCTGATGACAAACCCTTGGTCACACTGATTAAAACTAAAGATTTGTAAT
CTTTTTTTGGATTATTTTTCAAAAAGATGAGATACTACACTCATTTAAATATTTTTAAGAAAATAAAAAGCTTAA
GAAATTTAAAATGCTAGCTGCTCAAGAGTTTTCAGTAGAATATTTAAGAACTAATTTTCTGCAGCTTTTAGTTTG
GAAAAAATATTTTAAAAACAAAATTTGTGAAACCTATAGACGATGTTTTAATGTACCTTCAGCTCTCTAAACTGT
GTGCTTCTACTAGTGTGTGCTCTTTTCACTGTAGACACTATCACGAGACCCAGATTAATTTCTGTGGTTGTTACA
GAATAAGTCTAATCAAGGAGAAGTTTCTGTTTGACGTTTGAGTGCCGGCTTTCTGAGTAGAGTTAGGAAAACCAC
GTAACGTAGCATATGATGTATAATAGAGTATACCCGTTACTTAAAAAGAAGTCTGAAATGTTCGTTTTGTGGAAA
AGAAACTAGTTAAATTTACTATTCCTAACCCGAATGAAATTAGCCTTTGCCTTATTCTGTGCATGGGTAAGTAAC
TTATTTCTGCACTGTTTTGTTGAACTTTGTGGAAACATTCTTTCGAGTTTGTTTTTGTCATTTTCGTAACAGTCG
TCGAACTAGGCCTCAAAAACATACGTAACGAAAAGGCCTAGCGAGGCAAATTCTGATTGATTTGAATCTATATTT
TTCTTTAAAAAGTCAAGGGTTCTATATTGTGAGTAAATTAAATTTACATTTGAGTTGTTTGTTGCTAAGAGGTAG
TAAATGTAAGAGAGTACTGGTTCCTTCAGTAGTGAGTATTTCTCATAGTGCAGCTTTATTTATCTCCAGGATGTT
TTTGTGGCTGTATTTGATTGATATGTGCTTCTTCTGATTCTTGCTAATTTCCAACCATATTGAATAAATGTGATC
AAGTCA

FIGURE 38

><subunit 1 of 1, 737 aa, 1 stop
><MW: 78475, pI: 5.09, NX(S/T): 11
MQPRRAQAPGAQLLPALALLLLLLGAGPRGSSLANPVPAAPLSAPGPCAAQPCRNGGVCTSRP
EPDPQHPAPAGEPGYSCTCPAGISGANCQLVADPCASNPCHHGNCSSSSSSSSDGYLCICNEG
YEGPNCEQALPSLPATGWTESMAPRQLQPVPATQEPDKILPRSQATVTLPTWQPKTGQKVVEM
KWDQVEVIPDIACGNASSNSSAGGRLVSFEVPQNTSVKIRQDATASLILLWKVTATGFQQCSL
IDGRSVTPLQASGGLVLLEEMLALGNNHFIGFVNDSVTKSIVALRLTLVVKVSTCVPGESHAN
DLECSGKGKCTTKPSEATFSCTCEEQYVGTFCEEYDACQRKPCQNNASCIDANEKQDGSNFTC
VCLPGYTGELCQSKIDYCILDPCRNGATCISSLSGFTCQCPEGYFGSACEEKVDPCASSPCQN
NGTCYVDGVHFTCNCSPGFTGPTCAQLIDFCALSPCAHGTCRSVGTSYKCLCDPGYHGLYCEE
EYNECLSAPCLNAATCRDLVNGYECVCLAEYKGTHCELYKDPCANVSCLNGATCDSDGLNGTC
ICAPGFTGEECDIDINECDSNPCHHGGSCLDQPNGYNCHCPHGWVGANCEIHLQWKSGHMAES
LTNMPRHSLYIIIGALCVAFILMLIILIVGICRISRIEYQGSSRPAYEEFYNCRSIDSEFSNA
IASIRHARFGKKSRPAMYDVSPIAYEDYSPDDKPLVTLIKTKDL

Signal sequnce.
amino acids 1-28
Transmembrane domain.
amino acids 641-660
N-glycosylation sites.
amino acids 107-111, 204-208, 208-212, 223-227, 286-290, 361-365, 375-379, 442-446, 549-553, 564-568
Glycosaminoglycan attachment site.
amino acids 320-324
Tyrosine kinase phosphorylation sites.
amino acids 490-498, 674-682
N-myristoylation sites.
amino acids 30-36, 56-62, 57-63, 85-91, 106-112, 203-209, 373-379, 449-455, 480-486, 562-568, 565-571
Amidation site.
amino acids 702-706
Aspartic acid and asparagine hydroxylation site.
amino acids 520-532, 596-608
EGF-like domain cysteine pattern signatures.
amino acids 80-92, 121-133, 336-348, 378-390, 416-428, 454-466, 491-503, 529-541, 567-579, 605-617

FIGURE 39

GAGCCGCCGCCGCGCGCGCCGCGCACTGCAGCCCCAGGCCCCGGCCCCCACCCACGTCTG
CGTTGCTGCCCCGCCTGGGCCAGGCCCCAAAGGCAAGGACAAAGCAGCTGTCAGGGAACCTCC
GCCGGAGTCGAATTTACGTGCAGCTGCCGGCAACCACAGGTTCCAAGATGGTTTGCGGGGGCT
TCGCGTGTTCCAAGAACTGCCTGTGCGCCCTCAACCTGCTTTACACCTTGGTTAGTCTGCTGC
TAATTGGAATTGCTGCGTGGGGCATTGGCTTCGGGCTGATTTCCAGTCTCCGAGTGGTCGGCG
TGGTCATTGCAGTGGGCATCTTCTTGTTCCTGATTGCTTTAGTGGGTCTGATTGGAGCTGTAA
AACATCATCAGGTGTTGCTATTTTTTTATATGATTATTCTGTTACTTGTATTTATTGTTCAGT
TTTCTGTATCTTGCGCTTGTTTAGCCCTGAACCAGGAGCAACAGGGTCAGCTTCTGGAGGTTG
GTTGGAACAATACGGCAAGTGCTCGAAATGACATCCAGAGAAATCTAAACTGCTGTGGGTTCC
GAAGTGTTAACCCAAATGACACCTGTCTGGCTAGCTGTGTTAAAAGTGACCACTCGTGCTCGC
CATGTGCTCCAATCATAGGAGAATATGCTGGAGAGGTTTTGAGATTTGTTGGTGGCATTGGCC
TGTTCTTCAGTTTTACAGAGATCCTGGGTGTTTGGCTGACCTACAGATACAGGAACCAGAAAG
ACCCCCGCGCGAATCCTAGTGCATTCCTTTGATGAGAAAACAAGGAAGATTTCCTTTCGTATT
ATGATCTTGTTCACTTTCTGTAATTTTCTGTTAAGCTCCATTTGCCAGTTTAAGGAAGGAAAC
ACTATCTGGAAAAGTACCTTATTGATAGTGGAATTATATATTTTTACTCTATGTTTCTCTACA
TGTTTTTTTCTTTCCGTTGCTGAAAAATATTTGAAACTTGTGGTCTCTGAAGCTCGGTGGCAC
CTGGAATTTACTGTATTCATTGTCGGGCACTGTCCACTGTGGCCTTTCTTAGCATTTTTACCT
GCAGAAAAACTTTGTATGGTACCACTGTGTTGGTTATATGGTGAATCTGAACGTACATCTCAC
TGGTATAATTATATGTAGCACTGTGCTGTGTAGATAGTTCCTACTGGAAAAAGAGTGGAAATT
TATTAAAATCAGAAAGTATGAGATCCTGTTATGTTAAGGGAAATCCAAATTCCCAATTTTTTT
TGGTCTTTTTAGGAAAGATTGTTGTGGTAAAAAGTGTTAGTATAAAAATGATAATTTACTTGT
AGTCTTTTATGATTACACCAATGTATTCTAGAAATAGTTATGTCTTAGGAAATTGTGGTTTAA
TTTTTGACTTTTACAGGTAAGTGCAAAGGAGAAGTGGTTTCATGAAATGTTCTAATGTATAAT
AACATTTACCTTCAGCCTCCATCAGAATGGAACGAGTTTTGAGTAATCAGGAAGTATATCTAT
ATGATCTTGATATTGTTTTATAATAATTTGAAGTCTAAAAGACTGCATTTTTAAACAAGTTAG
TATTAATGCGTTGGCCCACGTAGCAAAAAGATATTTGATTATCTTAAAAATTGTTAAATACCG
TTTTCATGAAATTTCTCAGTATTGTAACAGCAACTTGTCAAACCTAAGCATATTTGAATATGA
TCTCCCATAATTTGAAATTGAAATCGTATTGTGTGGCTCTGTATATTCTGTTAAAAAATTAAA
GGACAGAAACCTTTCTTTGTGTATGCATGTTTGAATTAAAAGAAAGTAATGGAAG

FIGURE 40

></usr/seqdb2/sst/DNA/Dnaseqs.min/ss.DNA39979
><subunit 1 of 1, 204 aa, 1 stop
><MW: 22147, pI: 8.37, NX(S/T): 3
MVCGGFACSKNCLCALNLLYTLVSLLLIGIAAWGIGFGLISSLRVVGVVIAVGIFLFLIALVG
LIGAVKHHQVLLFFYMIILLLVFIVQFSVSCACLALNQEQQGQLLEVGWNNTASARNDIQRNL
NCCGFRSVNPNDTCLASCVKSDHSCSPCAPIIGEYAGEVLRFVGGIGLFFSFTEILGVWLTYR
YRNQKDPRANPSAFL

Signal Peptide:
amino acids 1-34

Transmembrane domains:
amino acids 47-63, 72-95 and 162-182

FIGURE 41

CAGTCACCATGAAGCTGGGCTGTGTCCTCATGGCCTGGGCCCTCTACCTTTCCCTTGGTGTGC
TCTGGGTGGCCCAGATGCTACTGGCTGCCAGTTTTGAGACGCTGCAGTGTGAGGGACCTGTCT
GCACTGAGGAGAGCAGCTGCCACACGGAGGATGACTTGACTGATGCAAGGGAAGCTGGCTTCC
AGGTCAAGGCCTACACTTTCAGTGAACCCTTCCACCTGATTGTGTCCTATGACTGGCTGATCC
TCCAAGGTCCAGCCAAGCCAGTTTTTGAAGGGGACCTGCTGGTTCTGCGCTGCCAGGCCTGGC
AAGACTGGCCACTGACTCAGGTGACCTTCTACCGAGATGGCTCAGCTCTGGGTCCCCCCGGGC
CTAACAGGGAATTCTCCATCACCGTGGTACAAAAGGCAGACAGCGGGCACTACCACTGCAGTG
GCATCTTCCAGAGCCCTGGTCCTGGGATCCCAGAAACAGCATCTGTTGTGGCTATCACAGTCC
AAGAACTGTTTCCAGCGCCAATTCTCAGAGCTGTACCCTCAGCTGAACCCCAAGCAGGAAGCC
CCATGACCCTGAGTTGTCAGACAAAGTTGCCCCTGCAGAGGTCAGCTGCCCGCCTCCTCTTCT
CCTTCTACAAGGATGGAAGGATAGTGCAAAGCAGGGGGCTCTCCTCAGAATTCCAGATCCCCA
CAGCTTCAGAAGATCACTCCGGGTCATACTGGTGTGAGGCAGCCACTGAGGACAACCAAGTTT
GGAAACAGAGCCCCCAGCTAGAGATCAGAGTGCAGGGTGCTTCCAGCTCTGCTGCACCTCCCA
CATTGAATCCAGCTCCTCAGAAATCAGCTGCTCCAGGAACTGCTCCTGAGGAGGCCCCTGGGC
CTCTGCCTCCGCCGCCAACCCCATCTTCTGAGGATCCAGGCTTTTCTTCTCCTCTGGGGATGC
CAGATCCTCATCTGTATCACCAGATGGGCCTTCTTCTCAAACACATGCAGGATGTGAGAGTCC
TCCTCGGTCACCTGCTCATGGAGTTGAGGGAATTATCTGGCCACCAGAAGCCTGGGACCACAA
AGGCTACTGCTGAATAGAAGTAAACAGTTCATCCATGATCTCACTTAACCACCCCAATAAATC
TGATTCTTTATTTTCTCTTCCTGTCCTGCACATATGCATAAGTACTTTTACAAGTTGTCCCAG
TGTTTTGTTAGAATAATGTAGTTAGGTGAGTGTAAATAAATTTATATAAAGTGAGAATTAGAG
TTTAGCTATAATTGTGTATTCTCTCTTAACACAACAGAATTCTGCTGTCTAGATCAGGAATTT
CTATCTGTTATATCGACCAGAATGTTGTGATTTAAAGAGAACTAATGGAAGTGGATTGAATAC
AGCAGTCTCAACTGGGGGCAATTTTGCCCCCCAGAGGACATTGGGCAATGTTTGGAGACATTT
TGGTCATTATACTTGGGGGGTTGGGGGATGGTGGGATGTGTGTCTACTGGCATCCAGTAAATA
GAAGCCAGGGGTGCCGCTAAACATCCTATAATGCACAGGGCAGTACCCCACAACGAAAAATAA
TCTGGCCCAAAATGTCAGTTGTACTGAGTTTGAGAAACCCCAGCCTAATGAAACCCTAGGTGT
TGGGCTCTGGAATGGGACTTTGTCCCTTCTAATTATTATCTCTTTCCAGCCTCATTCAGCTAT
TCTTACTGACATACCAGTCTTTAGCTGGTGCTATGGTCTGTTCTTTAGTTCTAGTTTGTATCC
CCTCAAAAGCCATTATGTTGAAATCCTAATCCCCAAGGTGATGGCATTAAGAAGTGGGCCTTT
GGGAAGTGATTAGATCAGGAGTGCAGAGCCCTCATGATTAGGATTAGTGCCCTTATTTAAAAA
GGCCCCAGAGAGCTAACTCACCCTTCCACCATATGAGGACGTGGCAAGAAGATGACATGTATG
AGAACCAAAAAACAGCTGTCGCCAAACACCGACTCTGTCGTTGCCTTGATCTTGAACTTCCAG
CCTCCAGAACTATGAGAAATAAAATTCTGGTTGTTTGTAGCCTAA

FIGURE 42

></usr/seqdb2/sst/DNA/Dnaseqs.min/ss.DNA40594
><subunit 1 of 1, 359 aa, 1 stop
><MW: 38899, pI: 5.21, NX(S/T): 0
MKLGCVLMAWALYLSLGVLWVAQMLLAASFETLQCEGPVCTEESSCHTEDDLTDAREAGFQVK
AYTFSEPFHLIVSYDWLILQGPAKPVFEGDLLVLRCQAWQDWPLTQVTFYRDGSALGPPGPNR
EFSITVVQKADSGHYHCSGIFQSPGPGIPETASVVAITVQELFPAPILRAVPSAEPQAGSPMT
LSCQTKLPLQRSAARLLFSFYKDGRIVQSRGLSSEFQIPTASEDHSGSYWCEAATEDNQVWKQ
SPQLEIRVQGASSSAAPPTLNPAPQKSAAPGTAPEEAPGPLPPPPTPSSEDPGFSSPLGMPDP
HLYHQMGLLLKHMQDVRVLLGHLLMELRELSGHQKPGTTKATAE

Signal sequence:
amino acids 1-17

Leucine zipper pattern sequence:
amino acids 12-33

Protein kinase C phosphorylation site:
amino acids 353-355

FIGURE 43

GCGAGTGTCCAGCTGCGGAGACCCGTGATAATTCGTTAACTAATTCAACAAACGGGACCCTTC
TGTGTGCCAGAAACCGCAAGCAGTTGCTAACCCAGTGGGACAGGCGGATTGGAAGAGCGGGAA
GGTCCTGGCCCAGAGCAGTGTGACACTTCCCTCTGTGACCATGAAACTCTGGGTGTCTGCATT
GCTGATGGCCTGGTTTGGTGTCCTGAGCTGTGTGCAGGCCGAATTCTTCACCTCTATTGGGCA
CATGACTGACCTGATTTATGCAGAGAAAGAGCTGGTGCAGTCTCTGAAAGAGTACATCCTTGT
GGAGGAAGCCAAGCTTTCCAAGATTAAGAGCTGGGCCAACAAAATGGAAGCCTTGACTAGCAA
GTCAGCTGCTGATGCTGAGGGCTACCTGGCTCACCCTGTGAATGCCTACAAACTGGTGAAGCG
GCTAAACACAGACTGGCCTGCGCTGGAGGACCTTGTCCTGCAGGACTCAGCTGCAGGTTTTAT
CGCCAACCTCTCTGTGCAGCGGCAGTTCTTCCCCACTGATGAGGACGAGATAGGAGCTGCCAA
AGCCCTGATGAGACTTCAGGACACATACAGGCTGGACCCAGGCACAATTTCCAGAGGGGAACT
TCCAGGAACCAAGTACCAGGCAATGCTGAGTGTGGATGACTGCTTTGGGATGGGCCGCTCGGC
CTACAATGAAGGGGACTATTATCATACGGTGTTGTGGATGGAGCAGGTGCTAAAGCAGCTTGA
TGCCGGGGAGGAGGCCACCACAACCAAGTCACAGGTGCTGGACTACCTCAGCTATGCTGTCTT
CCAGTTGGGTGATCTGCACCGTGCCCTGGAGCTCACCCGCCGCCTGCTCTCCCTTGACCCAAG
CCACGAACGAGCTGGAGGGAATCTGCGGTACTTTGAGCAGTTATTGGAGGAAGAGAGAGAAAA
AACGTTAACAAATCAGACAGAAGCTGAGCTAGCAACCCCAGAAGGCATCTATGAGAGGCCTGT
GGACTACCTGCCTGAGAGGGATGTTTACGAGAGCCTCTGTCGTGGGGAGGGTGTCAAACTGAC
ACCCCGTAGACAGAAGAGGCTTTTCTGTAGGTACCACCATGGCAACAGGGCCCCACAGCTGCT
CATTGCCCCCTTCAAAGAGGAGGACGAGTGGGACAGCCCGCACATCGTCAGGTACTACGATGT
CATGTCTGATGAGGAAATCGAGAGGATCAAGGAGATCGCAAAACCTAAACTTGCACGAGCCAC
CGTTCGTGATCCCAAGACAGGAGTCCTCACTGTCGCCAGCTACCGGGTTTCCAAAAGCTCCTG
GCTAGAGGAAGATGATGACCCTGTTGTGGCCCGAGTAAATCGTCGGATGCAGCATATCACAGG
GTTAACAGTAAAGACTGCAGAATTGTTACAGGTTGCAAATTATGGAGTGGGAGGACAGTATGA
ACCGCACTTCGACTTCTCTAGGCGACCTTTTGACAGCGGCCTCAAAACAGAGGGGAATAGGTT
AGCGACGTTTCTTAACTACATGAGTGATGTAGAAGCTGGTGGTGCCACCGTCTTCCCTGATCT
GGGGGCTGCAATTTGGCCTAAGAAGGGTACAGCTGTGTTCTGGTACAACCTCTTGCGGAGCGG
GGAAGGTGACTACCGAACAAGACATGCTGCCTGCCCTGTGCTTGTGGGCTGCAAGTGGGTCTC
CAATAAGTGGTTCCATGAACGAGGACAGGAGTTCTTGAGACCTTGTGGATCAACAGAAGTTGA
CTGACATCCTTTTCTGTCCTTCCCCTTCCTGGTCCTTCAGCCCATGTCAACGTGACAGACACC
TTTGTATGTTCCTTTGTATGTTCCTATCAGGCTGATTTTTGGAGAAATGAATGTTTGTCTGGA
GCAGAGGGAGACCATACTAGGGCGACTCCTGTGTGACTGAAGTCCCAGCCCTTCCATTCAGCC
TGTGCCATCCCTGGCCCCAAGGCTAGGATCAAAGTGGCTGCAGCAGAGTTAGCTGTCTAGCGC
CTAGCAAGGTGCCTTTGTACCTCAGGTGTTTAGGTGTGAGATGTTTCAGTGAACCAAAGTTC
TGATACCTTGTTTACATGTTTGTTTTTATGGCATTTCTATCTATTGTGGCTTTACCAAAAAT
AAAATGTCCCTACCAGAAAAAAAAAAA

FIGURE 44

MKLWVSALLMAWFGVLSCVQAEFFTSIGHMTDLIYAEKELVQSLKEYILVEEAKLSKIKSWAN
KMEALTSKSAADAEGYLAHPVNAYKLVKRLNTDWPALEDLVLQDSAAGFIANLSVQRQFFPTD
EDEIGAAKALMRLQDTYRLDPGTISRGELPGTKYQAMLSVDDCFGMGRSAYNEGDYYHTVLWM
EQVLKQLDAGEEATTTKSQVLDYLSYAVFQLGDLHRALELTRRLLSLDPSHERAGGNLRYFEQ
LLEEEREKTLTNQTEAELATPEGIYERPVDYLPERDVYESLCRGEGVKLTPRRQKRLFCRYHH
GNRAPQLLIAPFKEEDEWDSPHIVRYYDVMSDEEIERIKEIAKPKLARATVRDPKTGVLTVAS
YRVSKSSWLEEDDDPVVARVNRRMQHITGLTVKTAELLQVANYGVGGQYEPHFDFSRRPFDSG
LKTEGNRLATFLNYMSDVEAGGATVFPDLGAAIWPKKGTAVFWYNLLRSGEGDYRTRHAACPV
LVGCKWVSNKWFHERGQEFLRPCGSTEVD

Signal sequence:
amino acids 1-17
N-glycosylation site.
amino acids 115-119, 264-268
Glycosaminoglycan attachment site.
amino acids 490-494
cAMP- and cGMP-dependent protein kinase phosphorylation site.
amino acids 477-481
Casein kinase II phosphorylation site.
amino acids 43-47, 72-76, 125-129, 151-155, 165-169, 266-270, 346-350, 365-369, 385-389, 457-461, 530-534
Tyrosine kinase phosphorylation site.
amino acids 71-80, 489-496
N-myristoylation site.
amino acids 14-20, 131-137, 171-177, 446-452
Prokaryotic membrane lipoprotein lipid attachment site.
amino acids 8-19
Leucine zipper pattern.
amino acids 213-235

FIGURE 45

GGGGCCTTGCCTTCCGCACTCGGGCGCAGCCGGGTGGATCTCGAGCAGGTGCGGAGCCCCGGG
CGGCGGGCGCGGGTGCGAGGGATCCCTGACGCCTCTGTCCCTGTTTCTTTGTCGCTCCCAGCC
TGTCTGTCGTCGTTTTGGCGCCCCCGCCTCCCCGCGGTGCGGGGTTGCACACCGATCCTGGGC
TTCGCTCGATTTGCCGCCGAGGCGCCTCCCAGACCTAGAGGGGCGCTGGCCTGGAGCAGCGGG
TCGTCTGTGTCCTCTCTCCTCTGCGCCGCGCCCGGGGATCCGAAGGGTGCGGGGCTCTGAGGA
GGTGACGCGCGGGGCCTCCCGCACCCTGGCCTTGCCCGCATTCTCCCTCTCTCCCAGGTGTGA
GCAGCCTATCAGTCACCATGTCCGCAGCCTGGATCCCGGCTCTCGGCCTCGGTGTGTGTCTGC
TGCTGCTGCCGGGGCCCGCGGGCAGCGAGGGAGCCGCTCCCATTGCTATCACATGTTTTACCA
GAGGCTTGGACATCAGGAAAGAGAAAGCAGATGTCCTCTGCCCAGGGGGCTGCCCTCTTGAGG
AATTCTCTGTGTATGGGAACATAGTATATGCTTCTGTATCGAGCATATGTGGGGCTGCTGTCC
ACAGGGGAGTAATCAGCAACTCAGGGGGACCTGTACGAGTCTATAGCCTACCTGGTCGAGAAA
ACTATTCCTCAGTAGATGCCAATGGCATCCAGTCTCAAATGCTTTCTAGATGGTCTGCTTCTT
TCACAGTAACTAAAGGCAAAAGTAGTACACAGGAGGCCACAGGACAAGCAGTGTCCACAGCAC
ATCCACCAACAGGTAAACGACTAAAGAAAACACCCGAGAAGAAAACTGGCAATAAAGATTGTA
AAGCAGACATTGCATTTCTGATTGATGGAAGCTTTAATATTGGGCAGCGCCGATTTAATTTAC
AGAAGAATTTTGTTGGAAAAGTGGCTCTAATGTTGGGAATTGGAACAGAAGGACCACATGTGG
GCCTTGTTCAAGCCAGTGAACATCCCAAAATAGAATTTTACTTGAAAAACTTTACATCAGCCA
AAGATGTTTTGTTTGCCATAAAGGAAGTAGGTTTCAGAGGGGGTAATTCCAATACAGGAAAAG
CCTTGAAGCATACTGCTCAGAAATTCTTCACGGTAGATGCTGGAGTAAGAAAAGGGATCCCCA
AAGTGGTGGTGGTATTTATTGATGGTTGGCCTTCTGATGACATCGAGGAAGCAGGCATTGTGG
CCAGAGAGTTTGGTGTCAATGTATTTATAGTTTCTGTGGCCAAGCCTATCCCTGAAGAACTGG
GGATGGTTCAGGATGTCACATTTGTTGACAAGGCTGTCTGTCGGAATAATGGCTTCTTCTCTT
ACCACATGCCCAACTGGTTTGGCACCACAAAATACGTAAAGCCTCTGGTACAGAAGCTGTGCA
CTCATGAACAAATGATGTGCAGCAAGACCTGTTATAACTCAGTGAACATTGCCTTTCTAATTG
ATGGCTCCAGCAGTGTTGGAGATAGCAATTTCCGCCTCATGCTTGAATTTGTTTCCAACATAG
CCAAGACTTTTGAAATCTCGGACATTGGTGCCAAGATAGCTGCTGTACAGTTTACTTATGATC
AGCGCACGGAGTTCAGTTTCACTGACTATAGCACCAAAGAGAATGTCCTAGCTGTCATCAGAA
ACATCCGCTATATGAGTGGTGGAACAGCTACTGGTGATGCCATTTCCTTCACTGTTAGAAATG
TGTTTGGCCCTATAAGGGAGAGCCCCAACAAGAACTTCCTAGTAATTGTCACAGATGGGCAGT
CCTATGATGATGTCCAAGGCCCTGCAGCTGCTGCACATGATGCAGGAATCACTATCTTCTCTG
TTGGTGTGGCTTGGGCACCTCTGGATGACCTGAAAGATATGGCTTCTAAACCGAAGGAGTCTC
ACGCTTTCTTCACAAGAGAGTTCACAGGATTAGAACCAATTGTTTCTGATGTCATCAGAGGCA
TTTGTAGAGATTTCTTAGAATCCCAGCAATAATGGTAACATTTTGACAACTGAAAGAAAAAGT
ACAAGGGGATCCAGTGTGTAAATTGTATTCTCATAATACTGAAATGCTTTAGCATACTAGAAT
CAGATACAAAACTATTAAGTATGTCAACAGCCATTTAGGCAAATAAGCACTCCTTTAAAGCCG
CTGCCTTCTGGTTACAATTTACAGTGTACTTTGTTAAAAACACTGCTGAGGCTTCATAATCAT
GGCTCTTAGAAACTCAGGAAAGAGGAGATAATGTGGATTAAAACCTTAAGAGTTCTAACCATG
CCTACTAAATGTACAGATATGCAAATTCCATAGCTCAATAAAAGAATCTGATACTTAGACCAA
AAAAAAAAA

FIGURE 46

MSAAWIPALGLGVCLLLLPGPAGSEGAAPIAITCFTRGLDIRKEKADVLCPGGCPLEEFSVYG
NIVYASVSSICGAAVHRGVISNSGGPVRVYSLPGRENYSSVDANGIQSQMLSRWSASFTVTKG
KSSTQEATGQAVSTAHPPTGKRLKKTPEKKTGNKDCKADIAFLIDGSFNIGQRRFNLQKNFVG
KVALMLGIGTEGPHVGLVQASEHPKIEFYLKNFTSAKDVLFAIKEVGFRGGNSNTGKALKHTA
QKFFTVDAGVRKGIPKVVVVFIDGWPSDDIEEAGIVAREFGVNVFIVSVAKPIPEELGMVQDV
TFVDKAVCRNNGFFSYHMPNWFGTTKYVKPLVQKLCTHEQMMCSKTCYNSVNIAFLIDGSSSV
GDSNFRLMLEFVSNIAKTFEISDIGAKIAAVQFTYDQRTEFSFTDYSTKENVLAVIRNIRYMS
GGTATGDAISFTVRNVFGPIRESPNKNFLVIVTDGQSYDDVQGPAAAAHDAGITIFSVGVAWA
PLDDLKDMASKPKESHAFFTREFTGLEPIVSDVIRGICRDFLESQQ

Signal sequence:
amino acids 1-24

N-glycosylation site.
amino acids 100-104, 221-225

Casein kinase II phosphorylation site.
amino acids 102-106, 129-133, 224-228, 316-320, 377-381, 420-424, 425-429, 478-482, 528-532

N-myristoylation site.
amino acids 10-16, 23-29, 81-87, 135-141, 158-164, 205-211, 239-245, 240-246, 261-267, 403-409, 442-448, 443-449

Amidation site.
amino acids 145-149

FIGURE 47

GCCCCGCGCCCGGCGCCGGGCGCCCGAAGCCGGGAGCCACCGCCATGGGGGCCTGCCTGGGAG
CCTGCTCCCTGCTCAGCTGCGCGTCCTGCCTCTGCGGCTCTGCCCCCTGCATCCTGTGCAGCT
GCTGCCCCGCCAGCCGCAACTCCACCGTGAGCCGCCTCATCTTCACGTTCTTCCTCTTCCTGG
GGGTGCTGGTGTCCATCATTATGCTGAGCCCGGGCGTGGAGAGTCAGCTCTACAAGCTGCCCT
GGGTGTGTGAGGAGGGGGCCGGGATCCCCACCGTCCTGCAGGGCCACATCGACTGTGGCTCCC
TGCTTGGCTACCGCGCTGTCTACCGCATGTGCTTCGCCACGGCGGCCTTCTTCTTCTTCTTTT
TCACCCTGCTCATGCTCTGCGTGAGCAGCAGCCGGGACCCCCGGGCTGCCATCCAGAATGGGT
TTTGGTTCTTTAAGTTCCTGATCCTGGTGGGCCTCACCGTGGGTGCCTTCTACATCCCTGACG
GCTCCTTCACCAACATCTGGTTCTACTTCGGCGTCGTGGGCTCCTTCCTCTTCATCCTCATCC
AGCTGGTGCTGCTCATCGACTTTGCGCACTCCTGGAACCAGCGGTGGCTGGGCAAGGCCGAGG
AGTGCGATTCCCGTGCCTGGTACGCAGGCCTCTTCTTCTTCACTCTCCTCTTCTACTTGCTGT
CGATCGCGGCCGTGGCGCTGATGTTCATGTACTACACTGAGCCCAGCGGCTGCCACGAGGGCA
AGGTCTTCATCAGCCTCAACCTCACCTTCTGTGTCTGCGTGTCCATCGCTGCTGTCCTGCCCA
AGGTCCAGGACGCCCAGCCCAACTCGGGTCTGCTGCAGGCCTCGGTCATCACCCTCTACACCA
TGTTTGTCACCTGGTCAGCCCTATCCAGTATCCCTGAACAGAAATGCAACCCCCATTTGCCAA
CCCAGCTGGGCAACGAGACAGTTGTGGCAGGCCCCGAGGGCTATGAGACCCAGTGGTGGGATG
CCCCGAGCATTGTGGGCCTCATCATCTTCCTCCTGTGCACCCTCTTCATCAGTCTGCGCTCCT
CAGACCACCGGCAGGTGAACAGCCTGATGCAGACCGAGGAGTGCCCACCTATGCTAGACGCCA
CACAGCAGCAGCAGCAGCAGGTGGCAGCCTGTGAGGGCCGGGCCTTTGACAACGAGCAGGACG
GCGTCACCTACAGCTACTCCTTCTTCCACTTCTGCCTGGTGCTGGCCTCACTGCACGTCATGA
TGACGCTCACCAACTGGTACAAGCCCGGTGAGACCCGGAAGATGATCAGCACGTGGACCGCCG
TGTGGGTGAAGATCTGTGCCAGCTGGGCAGGGCTGCTCCTCTACCTGTGGACCCTGGTAGCCC
CACTCCTCCTGCGCAACCGCGACTTCAGCTGAGGCAGCCTCACAGCCTGCCATCTGGTGCCTC
CTGCCACCTGGTGCCTCTCGGCTCGGTGACAGCCAACCTGCCCCCTCCCCACACCAATCAGCC
AGGCTGAGCCCCCACCCCTGCCCCAGCTCCAGGACCTGCCCCTGAGCCGGGCCTTCTAGTCGT
AGTGCCTTCAGGGTCCGAGGAGCATCAGGCTCCTGCAGAGCCCCATCCCCCCGCCACACCCAC
ACGGTGGAGCTGCCTCTTCCTTCCCCTCCTCCCTGTTGCCCATACTCAGCATCTCGGATGAAA
GGGCTCCCTTGTCCTCAGGCTCCACGGGAGCGGGGCTGCTGGAGAGAGCGGGGAACTCCCACC
ACAGTGGGGCATCCGGCACTGAAGCCCTGGTGTTCCTGGTCACGTCCCCCAGGGGACCCTGCC
CCCTTCCTGGACTTCGTGCCTTACTGAGTCTCTAAGACTTTTTCTAATAAACAAGCCAGTGCG
TGTAAAAAAAA

FIGURE 48

MGACLGACSLLSCASCLCGSAPCILCSCCPASRNSTVSRLIFTFFLFLGVLVSIIMLSPGVES
QLYKLPWVCEEGAGIPTVLQGHIDCGSLLGYRAVYRMCFATAAFFFFFFTLLMLCVSSSRDPR
AAIQNGFWFFKFLILVGLTVGAFYIPDGSFTNIWFYFGVVGSFLFILIQLVLLIDFAHSWNQR
WLGKAEECDSRAWYAGLFFFTLLFYLLSIAAVALMFMYYTEPSGCHEGKVFISLNLTFCVCVS
IAAVLPKVQDAQPNSGLLQASVITLYTMFVTWSALSSIPEQKCNPHLPTQLGNETVVAGPEGY
ETQWWDAPSIVGLIIFLLCTLFISLRSSDHRQVNSLMQTEECPPMLDATQQQQQQVAACEGRA
FDNEQDGVTYSYSFFHFCLVLASLHVMMTLTNWYKPGETRKMISTWTAVWVKICASWAGLLLY
LWTLVAPLLLRNRDFS

Signal sequence:
amino acids 1-20

Transmembrane domains:
amino acids 40-58, 101-116, 134-150, 162-178, 206-223, 240-257, 272-283, 324-340, 391-406, 428-444

FIGURE 49

GCCGCGCGCTCTCTCCCGGCGCCCACACCTGTCTGAGCGGCGCAGCGAGCCGCGGCCCGGGCG
GGCTGCTCGGCGCGGAACAGTGCTCGGCATGGCAGGGATTCCAGGGCTCCTCTTCCTTCTCTT
CTTTCTGCTCTGTGCTGTTGGGCAAGTGAGCCCTTACAGTGCCCCCTGGAAACCCACTTGGCC
TGCATACCGCCTCCCTGTCGTCTTGCCCCAGTCTACCCTCAATTTAGCCAAGCCAGACTTTGG
AGCCGAAGCCAAATTAGAAGTATCTTCTTCATGTGGACCCCAGTGTCATAAGGGAACTCCACT
GCCCACTTACGAAGAGGCCAAGCAATATCTGTCTTATGAAACGCTCTATGCCAATGGCAGCCG
CACAGAGACGCAGGTGGGCATCTACATCCTCAGCAGTAGTGGAGATGGGGCCCAACACCGAGA
CTCAGGGTCTTCAGGAAAGTCTCGAAGGAAGCGGCAGATTTATGGCTATGACAGCAGGTTCAG
CATTTTTGGGAAGGACTTCCTGCTCAACTACCCTTTCTCAACATCAGTGAAGTTATCCACGGG
CTGCACCGGCACCCTGGTGGCAGAGAAGCATGTCCTCACAGCTGCCCACTGCATACACGATGG
AAAAACCTATGTGAAAGGAACCCAGAAGCTTCGAGTGGGCTTCCTAAAGCCCAAGTTTAAAGA
TGGTGGTCGAGGGGCCAACGACTCCACTTCAGCCATGCCCGAGCAGATGAAATTTCAGTGGAT
CCGGGTGAAACGCACCCATGTGCCCAAGGGTTGGATCAAGGGCAATGCCAATGACATCGGCAT
GGATTATGATTATGCCCTCCTGGAACTCAAAAAGCCCCACAAGAGAAAATTTATGAAGATTGG
GGTGAGCCCTCCTGCTAAGCAGCTGCCAGGGGGCAGAATTCACTTCTCTGGTTATGACAATGA
CCGACCAGGCAATTTGGTGTATCGCTTCTGTGACGTCAAAGACGAGACCTATGACTTGCTCTA
CCAGCAATGCGATGCCCAGCCAGGGGCCAGCGGGTCTGGGGTCTATGTGAGGATGTGGAAGAG
ACAGCAGCAGAAGTGGGAGCGAAAAATTATTGGCATTTTTTCAGGGCACCAGTGGGTGGACAT
GAATGGTTCCCCACAGGATTTCAACGTGGCTGTCAGAATCACTCCTCTCAAATATGCCCAGAT
TTGCTATTGGATTAAAGGAAACTACCTGGATTGTAGGGAGGGGTGACACAGTGTTCCCTCCTG
GCAGCAATTAAGGGTCTTCATGTTCTTATTTTAGGAGAGGCCAAATTGTTTTTTGTCATTGGC
GTGCACACGTGTGTGTGTGTGTGTGTGTGTGTGTAAGGTGTCTTATAATCTTTTACCTATTTC
TTACAATTGCAAGATGACTGGCTTTACTATTTGAAAACTGGTTTGTGTATCATATCATATATC
ATTTAAGCAGTTTGAAGGCATACTTTTGCATAGAAATAAAAAAAATACTGATTTGGGGCAATG
AGGAATATTTGACAATTAAGTTAATCTTCACGTTTTTGCAAACTTTGATTTTTATTTCATCTG
AACTTGTTTCAAAGATTTATATTAAATATTTGGCATACAAGAGATATGAAAAAAAAAAAAAAA

FIGURE 50

MAGIPGLLFLLFFLLCAVGQVSPYSAPWKPTWPAYRLPVVLPQSTLNLAKPDFGAEAKLEVSS
SCGPQCHKGTPLPTYEEAKQYLSYETLYANGSRTETQVGIYILSSSGDGAQHRDSGSSGKSRR
KRQIYGYDSRFSIFGKDFLLNYPFSTSVKLSTGCTGTLVAEKHVLTAAHCIHDGKTYVKGTQK
LRVGFLKPKFKDGGRGANDSTSAMPEQMKFQWIRVKRTHVPKGWIKGNANDIGMDYDYALLEL
KKPHKRKFMKIGVSPPAKQLPGGRIHFSGYDNDRPGNLVYRFCDVKDETYDLLYQQCDAQPGA
SGSGVYVRMWKRQQQKWERKIIGIFSGHQWVDMNGSPQDFNVAVRITPLKYAQICYWIKGNYL
DCREG

Signal sequence:
amino acids 1-19

N-glycosylation site.
amino acids 93-97, 207-211

Glycosaminoglycan attachment site.
amino acids 109-113, 316-320

Casein kinase II phosphorylation site.
amino acids 77-81, 95-99, 108-112, 280-284, 351-355

N-myristoylation site.
amino acids 159-165, 162-168, 202-208, 205-211, 314-320, 338-344

Serine proteases, trypsin family, histidine active site.
amino acids 171-177

FIGURE 51

GGGAGGGGGCTCCGGGCGCCGCGCAGCAGACCTGCTCCGGCCGCGCGCCTCGCCGCTGTCCTCCGGGAGCGGCAG
CAGTAGCCCGGGCGGCGAGGGCTGGGGGTTCCTCGAGACTCTCAGAGGGGCGCCTCCCATCGGCGCCCACCACCC
CAACCTGTTCCTCGCGCGCCACTGCGCTGCGCCCCAGGACCCGCTGCCCAACATGGATTTTCTCCTGGCGCTGGT
GCTGGTATCCTCGCTCTACCTGCAGGCGGCCGCCGAGTTCGACGGGAGGTGGCCCAGGCAAATAGTGTCATCGAT
TGGCCTATGTCGTTATGGTGGGAGGATTGACTGCTGCTGGGGCTGGGCTCGCCAGTCTTGGGGACAGTGTCAGCC
TGTGTGCCAACCACGATGCAAACATGGTGAATGTATCGGGCCAAACAAGTGCAAGTGTCATCCTGGTTATGCTGG
AAAAACCTGTAATCAAGATCTAAATGAGTGTGGCCTGAAGCCCCGGCCCTGTAAGCACAGGTGCATGAACACTTA
CGGCAGCTACAAGTGCTACTGTCTCAACGGATATATGCTCATGCCGGATGGTTCCTGCTCAAGTGCCCTGACCTG
CTCCATGGCAAACTGTCAGTATGGCTGTGATGTTGTTAAAGGACAAATACGGTGCCAGTGCCCATCCCCTGGCCT
GCACCTGGCTCCTGATGGGAGGACCTGTGTAGATGTTGATGAATGTGCTACAGGAAGAGCCTCCTGCCCTAGATT
TAGGCAATGTGTCAACACTTTTGGGAGCTACATCTGCAAGTGTCATAAAGGCTTCGATCTCATGTATATTGGAGG
CAAATATCAATGTCATGACATAGACGAATGCTCACTTGGTCAGTATCAGTGCAGCAGCTTTGCTCGATGTTATAA
CGTACGTGGGTCCTACAAGTGCAAATGTAAAGAAGGATACCAGGGTGATGGACTGACTTGTGTGTATATCCCAAA
AGTTATGATTGAACCTTCAGGTCCAATTCATGTACCAAAGGGAAATGGTACCATTTTAAAGGGTGACACAGGAAA
TAATAATTGGATTCCTGATGTTGGAAGTACTTGGTGGCCTCCGAAGACACCATATATTCCTCCTATCATTACCAA
CAGGCCTACTTCTAAGCCAACAACAAGACCTACACCAAAGCCAACACCAATTCCTACTCCACCACCACCACCACC
CCTGCCAACAGAGCTCAGAACACCTCTACCACCTACAACCCCAGAAAGGCCAACCACCGGACTGACAACTATAGC
ACCAGCTGCCAGTACACCTCCAGGAGGGATTACAGTTGACAACAGGGTACAGACAGACCCTCAGAAACCCAGAGG
AGATGTGTTCAGTGTTCTGGTACACAGTTGTAATTTTGACCATGGACTTTGTGGATGGATCAGGGAGAAAGACAA
TGACTTGCACTGGGAACCAATCAGGGACCCAGCAGGTGGACAATATCTGACAGTGTCGGCAGCCAAAGCCCCAGG
GGGAAAAGCTGCACGCTTGGTGCTACCTCTCGGCCGCCTCATGCATTCAGGGGACCTGTGCCTGTCATTCAGGCA
CAAGGTGACGGGGCTGCACTCTGGCACACTCCAGGTGTTTGTGAGAAAACACGGTGCCCACGGAGCAGCCCTGTG
GGGAAGAAATGGTGGCCATGGCTGGAGGCAAACACAGATCACCTTGCGAGGGGCTGACATCAAGAGCGAATCACA
AAGATGATTAAAGGGTTGGAAAAAAAGATCTATGATGGAAAATTAAAGGAACTGGGATTATTGAGCCTGGAGAAG
AGAAGACTGAGGGGCAAACCATTGATGGTTTTCAAGTATATGAAGGGTTGGCACAGAGAGGGTGGCGACCAGCTG
TTCTCCATATGCACTAAGAATAGAACAAGAGGAAACTGGCTTAGACTAGAGTATAAGGGAGCATTTCTTGGCAGG
GGCCATTGTTAGAATACTTCATAAAAAAAGAAGTGTGAAAATCTCAGTATCTCTCTCTCTTTCTAAAAAATTAGA
TAAAAATTTGTCTATTTAAGATGGTTAAAGATGTTCTTACCCAAGGAAAAGTAACAAATTATAGAATTTCCCAAA
AGATGTTTTGATCCTACTAGTAGTATGCAGTGAAAATCTTTAGAACTAAATAATTTGGACAAGGCTTAATTTAGG
CATTTCCCTCTTGACCTCCTAATGGAGAGGGATTGAAAGGGGAAGAGCCCACCAAATGCTGAGCTCACTGAAATA
TCTCTCCCTTATGGCAATCCTAGCAGTATTAAAGAAAAAAGGAAACTATTTATTCCAAATGAGAGTATGATGGAC
AGATATTTTAGTATCTCAGTAATGTCCTAGTGTGGCGGTGGTTTTCAATGTTTCTTCATGGTAAAGGTATAAGCC
TTTCATTTGTTCAATGGATGATGTTTCAGATTTTTTTTTTTTTTAAGAGATCCTTCAAGGAACACAGTTCAGAGAG
ATTTTCATCGGGTGCATTCTCTCTGCTTCGTGTGTGACAAGTTATCTTGGCTGCTGAGAAAGAGTGCCCTGCCCC
ACACCGGCAGACCTTTCCTTCACCTCATCAGTATGATTCAGTTTCTCTTATCAATTGGACTCTCCCAGGTTCCAC
AGAACAGTAATATTTTTTGAACAATAGGTACAATAGAAGGTCTTCTGTCATTTAACCTGGTAAAGGCAGGGCTGG
AGGGGGAAAATAAATCATTAAGCCTTTGAGTAACGGCAGAATATATGGCTGTAGATCCATTTTTAATGGTTCATT
TCCTTTATGGTCATATAACTGCACAGCTGAAGATGAAAGGGGAAAATAAATGAAAATTTTACTTTTCGATGCCAA
TGATACATTGCACTAAACTGATGGAAGAAGTTATCCAAAGTACTGTATAACATCTTGTTTATTATTTAATGTTTT
CTAAAATAAAAAATGTTAGTGGTTTTCCAAATGGCCTAATAAAAACAATTATTTGTAAATAAAAACACTGTTAGTAAT

FIGURE 52

MDFLLALVLVSSLYLQAAAEFDGRWPRQIVSSIGLCRYGGRIDCCWGWARQSWGQCQPVCQPR
CKHGECIGPNKCKCHPGYAGKTCNQDLNECGLKPRPCKHRCMNTYGSYKCYCLNGYMLMPDGS
CSSALTCSMANCQYGCDVVKGQIRCQCPSPGLHLAPDGRTCVDVDECATGRASCPRFRQCVNT
FGSYICKCHKGFDLMYIGGKYQCHDIDECSLGQYQCSSFARCYNVRGSYKCKCKEGYQGDGLT
CVYIPKVMIEPSGPIHVPKGNGTILKGDTGNNNWIPDVGSTWWPPKTPYIPPIITNRPTSKPT
TRPTPKPTPIPTPPPPPPLPTELRTPLPPTTPERPTTGLTTIAPAASTPPGGITVDNRVQTDP
QKPRGDVFSVLVHSCNFDHGLCGWIREKDNDLHWEPIRDPAGGQYLTVSAAKAPGGKAARLVL
PLGRLMHSGDLCLSFRHKVTGLHSGTLQVFVRKHGAHGAALWGRNGGHGWRQTQITLRGADIK
SESQR

Signal sequence:
amino acids 1-17

N-glycosylation site.
amino acids 273-277

Casein kinase II phosphorylation site.
amino acids 166-170, 345-349

Tyrosine kinase phosphorylation site.
amino acids 199-206

N-myristoylation site.
amino acids 109-115, 125-131, 147-153, 191-197, 221-227, 236-242, 421-427, 433-439, 462-468, 476-482

Aspartic acid and asparagine hydroxylation site.
amino acids 104-116, 186-198, 231-243

Cell attachment sequence.
amino acids 382-385

EGF-like domain cysteine pattern signature.
amino acids 75-87

FIGURE 53

CGGGCCGCCCCCGGCCCCCATTCGGGCCGGGCCTCGCTGCGGCGGCGACTGAGCCAGGCTGGG
CCGCGTCCCTGAGTCCCAGAGTCGGCGCGGCGCGGCAGGGGCAGCCTTCCACCACGGGGAGCC
CAGCTGTCAGCCGCCTCACAGGAAGATGCTGCGTCGGCGGGGCAGCCCTGGCATGGGTGTGCA
TGTGGGTGCAGCCCTGGGAGCACTGTGGTTCTGCCTCACAGGAGCCCTGGAGGTCCAGGTCCC
TGAAGACCCAGTGGTGGCACTGGTGGGCACCGATGCCACCCTGTGCTGCTCCTTCTCCCCTGA
GCCTGGCTTCAGCCTGGCACAGCTCAACCTCATCTGGCAGCTGACAGATACCAAACAGCTGGT
GCACAGCTTTGCTGAGGGCCAGGACCAGGGCAGCGCCTATGCCAACCGCACGGCCCTCTTCCC
GGACCTGCTGGCACAGGGCAACGCATCCCTGAGGCTGCAGCGCGTGCGTGTGGCGGACGAGGG
CAGCTTCACCTGCTTCGTGAGCATCCGGGATTTCGGCAGCGCTGCCGTCAGCCTGCAGGTGGC
CGCTCCCTACTCGAAGCCCAGCATGACCCTGGAGCCCAACAAGGACCTGCGGCCAGGGGACAC
GGTGACCATCACGTGCTCCAGCTACCAGGGCTACCCTGAGGCTGAGGTGTTCTGGCAGGATGG
GCAGGGTGTGCCCCTGACTGGCAACGTGACCACGTCGCAGATGGCCAACGAGCAGGGCTTGTT
TGATGTGCACAGCGTCCTGCGGGTGGTGCTGGGTGCGAATGGCACCTACAGCTGCCTGGTGCG
CAACCCCGTGCTGCAGCAGGATGCGCACRGCTCTGTCACCATCACAGGGCAGCCTATGACATT
CCCCCCAGAGGCCCTGTGGGTGACCGTGGGGCTGTCTGTCTGTCTCATTGCACTGCTGGTGGC
CCTGGCTTTCGTGTGCTGGAGAAAGATCAAACAGAGCTGTGAGGAGGAGAATGCAGGAGCTGA
GGACCAGGATGGGGAGGGAGAAGGCTCCAAGACAGCCCTGCAGCCTCTGAAACACTCTGACAG
CAAAGAAGATGATGGACAAGAAATAGCCTGACCATGAGGACCAGGGAGCTGCTACCCCTCCCT
ACAGCTCCTACCCTCTGGCTGCAATGGGGCTGCACTGTGAGCCCTGCCCCCAACAGATGCATC
CTGCTCTGACAGGTGGGCTCCTTCTCCAAAGGATGCGATACACAGACCACTGTGCAGCCTTAT
TTCTCCAATGGACATGATTCCCAAGTCATCCTGCTGCCTTTTTTCTTATAGACACAATGAACA
GACCACCCACAACCTTAGTTCTCTAAGTCATCCTGCCTGCTGCCTTATTTCACAGTACATACA
TTTCTTAGGGACACAGTACACTGACCACATCACCACCCTCTTCTTCCAGTGCTGCGTGGACCA
TCTGGCTGCCTTTTTTCTCCAAAAGATGCAATATTCAGACTGACTGACCCCCTGCCTTATTTC
ACCAAAGACACGATGCATAGTCACCCCGGCCTTGTTTCTCCAATGGCCGTGATACACTAGTGA
TCATGTTCAGCCCTGCTTCCACCTGCATAGAATCTTTTCTTCTCAGACAGGGACAGTGCGGCC
TCAACATCTCCTGGAGTCTAGAAGCTGTTTCCTTTCCCCTCCTTCCTCCCTGCCCCAAGTGAA
GACAGGGCAGGGCCAGGAATGCTTTGGGGACACCGAGGGGACTGCCCCCCACCCCCACCATGG
TGCTATTCTGGGGCTGGGGCAGTCTTTTCCTGGCTTGCCTCTGGCCAGCTCCTGGCCTCTGGT
AGAGTGAGACTTCAGACGTTCTGATGCCTTCCGGATGTCATCTCTCCCTGCCCCAGGAATGGA
AGATGTGAGGACTTCTAATTTAAATGTGGGACTCGGAGGGATTTTGTAAACTGGGGGTATATT
TTGGGGAAAATAAATGTCTTTGTAAAAAAAAAAAAAAAAAAAAA

FIGURE 54

></usr/seqdb2/sst/DNA/Dnaseqs.min/ss.DNA41386
><subunit 1 of 1, 316 aa, 1 stop, 1 unknown
><MW: -1, pI: 4.62, NX(S/T): 4
MLRRRGSPGMGVHVGAALGALWFCLTGALEVQVPEDPVVALVGTDATLCCSFSPEPGFSLAQL
NLIWQLTDTKQLVHSFAEGQDQGSAYANRTALFPDLLAQGNASLRLQRVRVADEGSFTCFVSI
RDFGSAAVSLQVAAPYSKPSMTLEPNKDLRPGDTVTITCSSYQGYPEAEVFWQDGQGVPLTGN
VTTSQMANEQGLFDVHSVLRVVLGANGTYSCLVRNPVLQQDAHXSVTITGQPMTFPPEALWVT
VGLSVCLIALLVALAFVCWRKIKQSCEEENAGAEDQDGEGEGSKTALQPLKHSDSKEDDGQEIA

Important features:
Signal peptide:
amino acids 1-28

Transmembrane domain:
amino acids 251-270

N-glycosylation site.
amino acids 91-94, 104-107, 189-192 and 215-218

Homologous region to Immunoglobulins and MHC
amino acids 217-234

FIGURE 55

GAGTCTTGACCGCCGCCGGGCTCTTGGTACCTCAGCGCGAGCGCCAGGCGTCCGGCCGCCGTG
GCTATGTTCGTGTCCGATTTCCGCAAAGAGTTCTACGAGGTGGTCCAGAGCCAGAGGGTCCTT
CTCTTCGTGGCCTCGGACGTGGATGCTCTGTGTGCGTGCAAGATCCTTCAGGCCTTGTTCCAG
TGTGACCACGTGCAATATACGCTGGTTCCAGTTTCTGGGTGGCAAGAACTTGAAACTGCATTT
CTTGAGCATAAAGAACAGTTTCATTATTTTATTCTCATAAACTGTGGAGCTAATGTAGACCTA
TTGGATATTCTTCAACCTGATGAAGACACTATATTCTTTGTGTGTGACTCCCATAGGCCAGTC
AATGTCGTCAATGTATACAACGATACCCAGATCAAATTACTCATTAAACAAGATGATGACCTT
GAAGTTCCCGCCTATGAAGACATCTTCAGGGATGAAGAGGAGGATGAAGAGCATTCAGGAAAT
GACAGTGATGGGTCAGAGCCTTCTGAGAAGCGCACACGGTTAGAAGAGGAGATAGTGGAGCAA
ACCATGCGGAGGAGGCAGCGGCGAGAGTGGGAGGCCCGGAGAAGAGACATCCTCTTTGACTAC
GAGCAGTATGAATATCATGGGACATCGTCAGCCATGGTGATGTTTGAGCTGGCTTGGATGCTG
TCCAAGGACCTGAATGACATGCTGTGGTGGGCCATCGTTGGACTAACAGACCAGTGGGTGCAA
GACAAGATCACTCAAATGAAATACGTGACTGATGTTGGTGTCCTGCAGCGCCACGTTTCCCGC
CACAACCACCGGAACGAGGATGAGGAGAACACACTCTCCGTGGACTGCACACGGATCTCCTTT
GAGTATGACCTCCGCCTGGTGCTCTACCAGCACTGGTCCCTCCATGACAGCCTGTGCAACACC
AGCTATACCGCAGCCAGGTTCAAGCTGTGGTCTGTGCATGGACAGAAGCGGCTCCAGGAGTTC
CTTGCAGACATGGGTCTTCCCCTGAAGCAGGTGAAGCAGAAGTTCCAGGCCATGGACATCTCC
TTGAAGGAGAATTTGCGGGAAATGATTGAAGAGTCTGCAAATAAATTTGGGATGAAGGACATG
CGCGTGCAGACTTTCAGCATTCATTTTGGGTTCAAGCACAAGTTTCTGGCCAGCGACGTGGTC
TTTGCCACCATGTCTTTGATGGAGAGCCCCGAGAAGGATGGCTCAGGGACAGATCACTTCATC
CAGGCTCTGGACAGCCTCTCCAGGAGTAACCTGGACAAGCTGTACCATGGCCTGGAACTCGCC
AAGAAGCAGCTGCGAGCCACCCAGCAGACCATTGCCAGCTGCCTTTGCACCAACCTCGTCATC
TCCCAGGGGCCTTTCCTGTACTGCTCTCTCATGGAGGGCACTCCAGATGTCATGCTGTTCTCT
AGGCCGGCATCCCTAAGCCTGCTCAGCAAACACCTGCTCAAGTCCTTTGTGTGTTCGACAAAG
AACCGGCGCTGCAAACTGCTGCCCCTGGTGATGGCTGCCCCCCTGAGCATGGAGCATGGCACA
GTGACCGTGGTGGGCATCCCCCCAGAGACCGACAGCTCGGACAGGAAGAACTTTTTTGGGAGG
GCGTTTGAGAAGGCAGCGGAAAGCACCAGCTCCCGGATGCTGCACAACCATTTTGACCTCTCA
GTAATTGAGCTGAAAGCTGAGGATCGGAGCAAGTTTCTGGACGCACTTATTTCCCTCCTGTCC
TAGGAATTTGATTCTTCCAGAATGACCTTCTTATTTATGTAACTGGCTTTCATTTAGATTGTA
AGTTATGGACATGATTTGAGATGTAGAAGCCATTTTTATTAAATAAAATGCTTATTTTAGGAAA

FIGURE 56

MFVSDFRKEFYEVVQSQRVLLFVASDVDALCACKILQALFQCDHVQYTLVPVSGWQELETAFL
EHKEQFHYFILINCGANVDLLDILQPDEDTIFFVCDSHRPVNVVNVYNDTQIKLLIKQDDDLE
VPAYEDIFRDEEEDEEHSGNDSDGSEPSEKRTRLEEEIVEQTMRRRQRREWEARRRDILFDYE
QYEYHGTSSAMVMFELAWMLSKDLNDMLWWAIVGLTDQWVQDKITQMKYVTDVGVLQRHVSRH
NHRNEDEENTLSVDCTRISFEYDLRLVLYQHWSLHDSLCNTSYTAARFKLWSVHGQKRLQEFL
ADMGLPLKQVKQKFQAMDISLKENLREMIEESANKFGMKDMRVQTFSIHFGFKHKFLASDVVF
ATMSLMESPEKDGSGTDHFIQALDSLSRSNLDKLYHGLELAKKQLRATQQTIASCLCTNLVIS
QGPFLYCSLMEGTPDVMLFSRPASLSLLSKHLLKSFVCSTKNRRCKLLPLVMAAPLSMEHGTV
TVVGIPPETDSSDRKNFFGRAFEKAAESTSSRMLHNHFDLSVIELKAEDRSKFLDALISLLS

FIGURE 57

CGCCGCCGTTGGGGCTGGAAGTTCCCGCCAGGTCCGTGCCGGGCGAGAGAGATGCTGCCCGGC
CCGCCTCGGCTTTGAGGCGAGAGAAGTGTCCCAGACCCATTTCGCCTTGCTGACGGCGTCGAG
CCCTGGCCAGACATGTCCACAGGGTTCTCCTTCGGGTCCGGGACTCTGGGCTCCACCACCGTG
GCCGCCGGCGGGACCAGCACAGGCGGCGTTTTCTCCTTCGGAACGGGAACGTCTAGCAACCCT
TCTGTGGGGCTCAATTTTGGAAATCTTGGAAGTACTTCAACTCCAGCAACTACATCTGCTCCT
TCAAGTGGTTTTGGAACCGGGCTCTTTGGATCTAAACCTGCCACTGGGTTCACTCTAGGAGGA
ACAAATACAGGTGCCTTGCACACCAAGAGGCCTCAAGTGGTCACCAAATATGGAACCCTGCAA
GGAAAACAGATGCATGTGGGGAAGACACCCATCCAAGTCTTTTTAGGAGTCCCCTTCTCCAGA
CCTCCTCTAGGTATCCTCAGGTTTGCACCTCCAGAACCCCCGGAGCCCTGGAAAGGAATCAGA
GATGCTACCACCTACCCGCCTGGATGGAGTCTCGCTCTGTCGCCAGGCTGGAGTGCAGTGGCA
CGATCTCGGCTCACTGCAACCTCCGCCTCCCGGGTTCAAGCGAGTCTCCTGCCTCAGCCTCTG
AGTGTCTGGGGCTACAGGTGCCTGCAGGAGTCCTGGGGCCAGCTGGCCTCGATGTACGTCAGC
ACGCGGGAACGGTACAAGTGGCTGCGCTTCAGCGAGGACTGTCTGTACCTGAACGTGTACGCG
CCGGCGCGCGCGCCCGGGGATCCCCAGCTGCCAGTGATGGTCTGGTTCCCGGGAGGCGCCTTC
ATCGTGGGCGCTGCTTCTTCGTACGAGGGCTCTGACTTGGCCGCCCGCGAGAAAGTGGTGCTG
GTGTTTCTGCAGCACAGGCTCGGCATCTTCGGCTTCCTGAGCACGGACGACAGCCACGCGCGC
GGGAACTGGGGGCTGCTGGACCAGATGGCGGCTCTGCGCTGGGTGCAGGAGAACATCGCAGCC
TTCGGGGGAGACCCAGGAAATGTGACCCTGTTCGGCCAGTCGGCGGGGGCCATGAGCATCTCA
GGACTGATGATGTCACCCCTAGCCTCGGGTCTCTTCCATCGGGCCATTTCCCAGAGTGGCACC
GCGTTATTCAGACTTTTCATCACTAGTAACCCACTGAAAGTGGCCAAGAAGGTTGCCCACCTG
GCTGGATGCAACCACAACAGCACACAGATCCTGGTAAACTGCCTGAGGGCACTATCAGGGACC
AAGGTGATGCGTGTGTCCAACAAGATGAGATTCCTCCAACTGAACTTCCAGAGAGACCCGGAA
GAGATTATCTGGTCCATGAGCCCTGTGGTGGATGGTGTGGTGATCCCAGATGACCCTTTGGTG
CTCCTGACCCAGGGGAAGGTTTCATCTGTGCCCTACCTTCTAGGTGTCAACAACCTGGAATTC
AATTGGCTCTTGCCTTATAATATCACCAAGGAGCAGGTACCACTTGTGGTGGAGGAGTACCTG
GACAATGTCAATGAGCATGACTGGAAGATGCTACGAAACCGTATGATGGACATAGTTCAAGAT
GCCACTTTCGTGTATGCCACACTGCAGACTGCTCACTACCACCGAGAAACCCCAATGATGGGA
ATCTGCCCTGCTGGCCACGCTACAACAAGGATGAAAAGTACCTGCAGCTGGATTTTACCACAA
GAGTGGGCATGAAGCTCAAGGAGAAGAAGATGGCTTTTTGGATGAGTCTGTACCAGTCTCAAA
GACCTGAGAAGCAGAGGCAATTCTAAGGGTGGCTATGCAGGAAGGAGCCAAAGAGGGGTTTGC
CCCCACCATCCAGGCCCTGGGGAGACTAGCCATGGACATACCTGGGGACAAGAGTTCTACCCA
CCCCAGTTTAGAACTGCAGGAGCTCCCTGCTGCCTCCAGGCCAAAGCTAGAGCTTTTGCCTGT
TGTGTGGGACCTGCACTGCCCTTTCCAGCCTGACATCCCATGATGCCCCTCTACTTCACTGTT
GACATCCAGTTAGGCCAGGCCCTGTCAACACCACACTGTGCTCAGCTCTCCAGCCTCAGGACA
ACCTCTTTTTTTCCCTTCTTCAAATCCTCCCACCCTTCAATGTCTCCTTGTGACTCCTTCTTA
TGGGAGGTCGACCCAGACTGCCACTGCCCCTGTCACTGCACCCAGCTTGGCATTTACCATCCA
TCCTGCTCAACCTTGTTCCTGTCTGTTCACATTGGCCTGGAGGCCTAGGGCAGGTTGTGACAT
GGAGCAAACTTTTGGTAGTTTGGGATCTTCTCTCCCACCCACACTTATCTCCCCCAGGGCCAC
TCCAAAGTCTATACACAGGGGTGGTCTCTTCAATAAAGAAGTGTTGATTAGAAAAAAAAAAA

FIGURE 58

</usr/seqdb2/sst/DNA/Dnaseqs.min/ss.DNA44179
<subunit 1 of 1, 545 aa, 1 stop
<MW: 58934, pI: 9.45, NX(S/T): 4
MSTGFSFGSGTLGSTTVAAGGTSTGGVFSFGTGTSSNPSVGLNFGNLGSTSTPATTSAPSSGF
GTGLFGSKPATGFTLGGTNTGALHTKRPQVVTKYGTLQGKQMHVGKTPIQVFLGVPFSRPPLG
ILRFAPPEPPEPWKGIRDATTYPPGWSLALSPGWSAVARSRLTATSASRVQASLLPQPLSVWG
YRCLQESWGQLASMYVSTRERYKWLRFSEDCLYLNVYAPARAPGDPQLPVMVWFPGGAFIVGA
ASSYEGSDLAAREKVVLVFLQHRLGIFGFLSTDDSHARGNWGLLDQMAALRWVQENIAAFGGD
PGNVTLFGQSAGAMSISGLMMSPLASGLFHRAISQSGTALFRLFITSNPLKVAKKVAHLAGCN
HNSTQILVNCLRALSGTKVMRVSNKMRFLQLNFQRDPEEIIWSMSPVVDGVVIPDDPLVLLTQ
GKVSSVPYLLGVNNLEFNWLLPYNITKEQVPLVVEEYLDNVNEHDWKMLRNRMMDIVQDATFV
YATLQTAHYHRETPMMGICPAGHATTRMKSTCSWILPQEWA

Important features:
Signal peptide:
amino acids 1-29

Carboxylesterases type-B serine active site.
amino acids 312-327

Carboxylesterases type-B signature 2.
amino acids 218-228

N-glycosylation sites.
amino acids 318-321, 380-383 and 465-468

FIGURE 59

CGGACGCGTGGGCTGGGCGCTGCAAAGCGTGTCCCGCCGGGTCCCCGAGCGTCCCGCGCCCTC
GCCCCGCCATGCTCCTGCTGCTGGGGCTGTGCCTGGGGCTGTCCCTGTGTGTGGGGTCGCAGG
AAGAGGCGCAGAGCTGGGGCCACTCTTCGGAGCAGGATGGACTCAGGGTCCCGAGGCAAGTCA
GACTGTTGCAGAGGCTGAAAACCAAACCTTTGATGACAGAATTCTCAGTGAAGTCTACCATCA
TTTCCCGTTATGCCTTCACTACGGTTTCCTGCAGAATGCTGAACAGAGCTTCTGAAGACCAGG
ACATTGAGTTCCAGATGCAGATTCCAGCTGCAGCTTTCATCACCAACTTCACTATGCTTATTG
GAGACAAGGTGTATCAGGGCGAAATTACAGAGAGAGAAAAGAAGAGTGGTGATAGGGTAAAAG
AGAAAAGGAATAAAACCACAGAAGAAAATGGAGAGAAGGGGACTGAAATATTCAGAGCTTCTG
CAGTGATTCCCAGCAAGGACAAAGCCGCCTTTTTCCTGAGTTATGAGGAGCTTCTGCAGAGGC
GCCTGGGCAAGTACGAGCACAGCATCAGCGTGCGGCCCCAGCAGCTGTCCGGGAGGCTGAGCG
TGGACGTGAATATCCTGGAGAGCGCGGGCATCGCATCCCTGGAGGTGCTGCCGCTTCACAACA
GCAGGCAGAGGGGCAGTGGGCGCGGGGAAGATGATTCTGGGCCTCCCCCATCTACTGTCATTA
ACCAAAATGAAACATTTGCCAACATAATTTTTAAACCTACTGTAGTACAACAAGCCAGGATTG
CCCAGAATGGAATTTTGGGAGACTTTATCATTAGATATGACGTCAATAGAGAACAGAGCATTG
GGGACATCCAGGTTCTAAATGGCTATTTTGTGCACTACTTTGCTCCTAAAGACCTTCCTCCTT
TACCCAAGAATGTGGTATTCGTGCTTGACAGCAGTGCTTCTATGGTGGGAACCAAACTCCGGC
AGACCAAGGATGCCCTCTTCACAATTCTCCATGACCTCCGACCCCAGGACCGTTTCAGTATCA
TTGGATTTTCCAACCGGATCAAAGTATGGAAGGACCACTTGATATCAGTCACTCCAGACAGCA
TCAGGGATGGGAAAGTGTACATTCACCATATGTCACCCACTGGAGGCACAGACATCAACGGGG
CCCTGCAGAGGGCCATCAGGCTCCTCAACAAGTACGTGGCCCACAGTGGCATTGGAGACCGGA
GCGTGTCCCTCATCGTCTTCCTGACGGATGGGAAGCCCACGGTCGGGGAGACGCACACCCTCA
AGATCCTCAACAACACCCGAGAGGCCGCCCGAGGCCAAGTCTGCATCTTCACCATTGGCATCG
GCAACGACGTGGACTTCAGGCTGCTGGAGAAACTGTCGCTGGAGAACTGTGGCCTCACACGGC
GCGTGCACGAGGAGGAGGACGCAGGCTCGCAGCTCATCGGGTTCTACGATGAAATCAGGACCC
CGCTCCTCTCTGACATCCGCATCGATTATCCCCCCAGCTCAGTGGTGCAGGCCACCAAGACCC
TGTTCCCCAACTACTTCAACGGCTCGGAGATCATCATTGCGGGGAAGCTGGTGGACAGGAAGC
TGGATCACCTGCACGTGGAGGTCACCGCCAGCAACAGTAAGAAATTCATCATCCTGAAGACAG
ATGTGCCTGTGCGGCCTCAGAAGGCAGGGAAAGATGTCACAGGAAGCCCCAGGCCTGGAGGCG
ATGGAGAGGGGGACACCAACCACATCGAGCGTCTCTGGAGCTACCTCACCACAAAGGAGCTGC
TGAGCTCCTGGCTGCAAAGTGACGATGAACCGGAGAAGGAGCGGCTGCGGCAGCGGGCCCAGG
CCCTGGCTGTGAGCTACCGCTTCCTCACTCCCTTCACCTCCATGAAGCTGAGGGGGCCGGTCC
CACGCATGGATGGCCTGGAGGAGGCCCACGGCATGTCGGCTGCCATGGGACCCGAACCGGTGG
TGCAGAGCGTGCGAGGAGCTGGCACGCAGCCAGGACCTTTGCTCAAGAAGCCAAACTCCGTCA
AAAAAAAACAAAACAAAACAAAAAAAAGACATGGGAGAGATGGTGTTTTTCCTCTCCACCACC
TGGGGATACGATGAGAAGATGGCCACCTGCAAGCCAGGAAGACGGCCCTCACCAGACACCATG
TCTGCTGGCACCTTGATCTTGGACCTCCCAGCCTCCAGAACTGTGAGAAATAAATGTGTTTTG
TTTAAGCTAAAAAAAAAAAAAAAAAAAAAAAAAAAAAAAAAAAAAAAAAAAAAAAAAAAAAA

FIGURE 60

</usr/seqdb2/sst/DNA/Dnaseqs.min/ss.DNA44192
<subunit 1 of 1, 694 aa, 1 stop
<MW: 77400, pI: 9.54, NX(S/T): 6
MLLLLGLCLGLSLCVGSQEEAQSWGHSSEQDGLRVPRQVRLLQRLKTKPLMTEFSVKSTIISR
YAFTTVSCRMLNRASEDQDIEFQMQIPAAAFITNFTMLIGDKVYQGEITEREKKSGDRVKEKR
NKTTEENGEKGTEIFRASAVIPSKDKAAFFLSYEELLQRRLGKYEHSISVRPQQLSGRLSVDV
NILESAGIASLEVLPLHNSRQRGSGRGEDDSGPPPSTVINQNETFANIIFKPTVVQQARIAQN
GILGDFIIRYDVNREQSIGDIQVLNGYFVHYFAPKDLPPLPKNVVFVLDSSASMVGTKLRQTK
DALFTILHDLRPQDRFSIIGFSNRIKVWKDHLISVTPDSIRDGKVYIHHMSPTGGTDINGALQ
RAIRLLNKYVAHSGIGDRSVSLIVFLTDGKPTVGETHTLKILNNTREAARGQVCIFTIGIGND
VDFRLLEKLSLENCGLTRRVHEEEDAGSQLIGFYDEIRTPLLSDIRIDYPPSSVVQATKTLFP
NYFNGSEIIIAGKLVDRKLDHLHVEVTASNSKKFIILKTDVPVRPQKAGKDVTGSPRPGGDGE
GDTNHIERLWSYLTTKELLSSWLQSDDEPEKERLRQRAQALAVSYRFLTPFTSMKLRGPVPRM
DGLEEAHGMSAAMGPEPVVQSVRGAGTQPGPLLKKPNSVKKKQNKTKKRHGRDGVFPLHHLGIR

Signal sequence.
amino acids 1-14

N-glycosylation sites.
amino acids 97-101, 127-131, 231-235, 421-425, 508-512, 674-678

Glycosaminoglycan attachment sites.
amino acids 213-217, 391-395

N-myristoylation sites.
amino acids 6-12, 10-16, 212-218, 370-376, 632-638, 638-644

FIGURE 61

CAGGAACCCTCTCTTTGGGTCTGGATTGGGACCCCTTTCCAGTACCATTTTTTCTAGTGAACC
ACGAAGGGACGATACCAGAAAACACCCTCAACCCAAAGGAAATAGACTACAGCCCCAATTGGC
TGACTTTGGCTATAGAAAAAAGAAAGGAACGAAAAGAGACAGTTTTTTTTGGAAAGCTAAGTC
TTCCCTTTATCGAGTCAAGAAACCCCCCCTTCTTGAGCTATTTACAGCTTTTAACAATTGAGT
AAAGTACGCTCCGGTCACCATGGTGACAGCCGCCCTGGGTCCCGTCTGGGCAGCGCTCCTGCT
CTTTCTCCTGATGTGTGAGATCCGTATGGTGGAGCTCACCTTTGACAGAGCTGTGGCCAGCGG
CTGCCAACGGTGCTGTGACTCTGAGGACCCCCTGGATCCTGCCCATGTATCCTCAGCCTCTTC
CTCCGGCCGCCCCCACGCCCTGCCTGAGATCAGACCCTACATTAATATCACCATCCTGAAGGG
TGACAAAGGGGACCCAGGCCCAATGGGCCTGCCAGGGTACATGGGCAGGGAGGGTCCCCAAGG
GGAGCCTGGCCCTCAGGGCAGCAAGGGTGACAAGGGGGAGATGGGCAGCCCCGGCGCCCCGTG
CCAGAAGCGCTTCTTCGCCTTCTCAGTGGGCCGCAAGACGGCCCTGCACAGCGGCGAGGACTT
CCAGACGCTGCTCTTCGAAAGGGTCTTTGTGAACCTTGATGGGTGCTTTGACATGGCGACCGG
CCAGTTTGCTGCTCCCCTGCGTGGCATCTACTTCTTCAGCCTCAATGTGCACAGCTGGAATTA
CAAGGAGACGTACGTGCACATTATGCATAACCAGAAAGAGGCTGTCATCCTGTACGCGCAGCC
CAGCGAGCGCAGCATCATGCAGAGCCAGAGTGTGATGCTGGACCTGGCCTACGGGGACCGCGT
CTGGGTGCGGCTCTTCAAGCGCCAGCGCGAGAACGCCATCTACAGCAACGACTTCGACACCTA
CATCACCTTCAGCGGCCACCTCATCAAGGCCGAGGACGACTGAGGGCCTCTGGGCCACCCTCC
CGGCTGGAGAGCTCAGGTGCTGGTCCCGTCCCCTGCAGGGCTCAGTTTGCACTGCTGTGAAGC
AGGAAGGCCAGGGAGGTCCCCGGGGACCTGGCATTCTGGGGAGACCCTGCTTCTATCTTGGCT
GCCATCATCCCTCCCAGCCTATTTCTGCTCCTCTCTTCTCTCTTGGACCTATTTTAAGAAGCT
TGCTAACCTAAATATTCTAGAACTTTCCCAGCCTCGTAGCCCAGCACTTCTCAAACTTGGAAA
TGCATGCGAATCACCCGGGGTTCGTGTTAAATGCAGATTCTGACTCAGCAGGTCTGAGTGGGT
CCAGGATTCTGTGTTTCTCATATGTTCCTGGGTGATGCTGATGGGGTCAGTCTATGAACCACA
CTGGAGCAACCAGGTTCTAGGACTTTCTCAATATTCTAGTACTTTCTGAACATTCTGGAATCC
TCCCCACATTCTAGAATTCTCCCAACATTTTTTTTTCTTGAGACAGAGTCTTGCTCTGTTGCC
CAGGCTAGAGTGCAGTGGTGCAATCTCAGTTCACTGCAACCTCTGCCTCCCGGGTTCAAGCGA
TTCTTCTGCCTCAGCCTCCCTAGTGGCTGGGATTACAGGCGCCTGCTACCATGCCTGGCTAAT
TTTTGTATTTTTAGTAGAGATGGGGTTTCACCATATTGGCCAGGCTGGTCTTGAACTCCTGAC
TTCAGGTGACCCACCCGCCTCGGCCTCTCAAAATGCTGGGATTACAGGTGTGAGCCACCGTGC
CTGGCCAATTCCAACATTCTTAAATTCTCTCATCCCTCCAGGGCTCCCCGTGCTATGTTCTCT
TTACCCCTTCCCCCTCTTCTCTTGCTCAGGCCTGCACCACTGCAGCCACCGTTCATTTATTCA
TTCATTAAACACTGAGCACTCACTCTGTGCTGGGTCCCGGGAAGGGTGAGGGGGTCAGACACA
GGCCCTGCCCCTGCCCTCAGTGACTGGCCAGTCCAGCCCAGGCGGGGAGAGATGTGTACATAG
GTTTTAAAGCAGACCCAGAGCTCATGGGGGCCTGTGTTCTGGGTGTTCAGGTGCTGCTGGTCC
TCCATTACCCACTGCTCCCCAAGGCTGGTGGGACGGGGTCCCGGTGGCAGGGGCAGGTATCTC
CTTCCCGTTCCTCATCCACCTGCCCAGTGCTCATCGTTACAGCAAACCCCAGGGGGCCTTGGC
CAGGTCAAGGGTTCTGTGAGGAGAGGACCCAGGAGTGTGGGGGCATTTGGGGGGTGAAGTGGC
CCCCGAAGAATGGAACCCACACCCATAGCTCTCCCCACAGCTGATACGGCATCCTGCGAGAAG
ACCTGCCCTCCTCACTGGGATCCCCTTCCTGCCTCCTCCCAGGGCTCTGCCAGGGCCTTGCTC
AGTCCCTTCCACCAAAGTCATCTGAACTTCCGTTTCCCCAGGGCCTCCAGCTGCCCTCAGACA
CTGATGTCTGTCCCCAGGTGCTCTCTGCCCCTCATGCCCCTCTCACCGGCCCAGTGCCCCGAC
TCTCCAGGCTTTATCAAGGTGCTAAGGCCCGGGTGGGCAGCTCCTCGTCTCAGAGCCCTCCTC
CGGCCTGGTGCTGCCTTTACAAACACCTGCAGGAGAAGGGCCACGGAAGCCCCAGGCTTTAGA
GCCCTCAGCAGGTCTGGGGAGCTAGAGCAAAGGAGGGACCTCAGGCCTTCCGTTTCTTCTTCC
AGGGTGGGGTGGCCTGGTGTTCCCCTAGCCTTCCAAACCCAGGTGGCCTGCCCTTCTCCCCAG
AGGGAGGCGGCCTCCGCCCATTGGTGCTCATGCAGACTCTGGGGCTGAGGTGCCCCGGGGGGT
GATCTCTGGTGCTCACAGCCGAGGGAGCCGTGGCTCCATGGCCAGATGACGGAAACAGGGTCT
GACCAAGTGCCAGGAAGACCTGTGCTATAAACCACCCTGCCTGATCCTGCCCCTGCCTGACCC
CGCCACGCCCTGCCGTCCAGCATGATTAAAGAATGCTGTCTCCTCTTGGAAAAAAAAAAAAAAA

FIGURE 62

MVTAALGPVWAALLLFLLMCEIRMVELTFDRAVASGCQRCCDSEDPLDPAHVSSASSSGRPHA
LPEIRPYINITILKGDKGDPGPMGLPGYMGREGPQGEPGPQGSKGDKGEMGSPGAPCQKRFFA
FSVGRKTALHSGEDFQTLLFERVFVNLDGCFDMATGQFAAPLRGIYFFSLNVHSWNYKETYVH
IMHNQKEAVILYAQPSERSIMQSQSVMLDLAYGDRVWVRLFKRQRENAIYSNDFDTYITFSGH
LIKAEDD

Important features:
Signal peptide:
amino acids 1-20

N-glycosylation site.
amino acids 72-75

C1q domain proteins.
amino acids 144-178, 78-111 and 84-117

FIGURE 63

ATGGGAAGCCAGTAACACTGTGGCCTACTATCTCTTCCGTGGTGCCATCTACATTTTTGGGAC
TCGGGAATTATGAGGTAGAGGTGGAGGCGGAGCCGGATGTCAGAGGTCCTGAAATAGTCACCA
TGGGGGAAAATGATCCGCCTGCTGTTGAAGCCCCCTTCTCATTCCGATCGCTTTTTGGCCTTG
ATGATTTGAAAATAAGTCCTGTTGCACCAGATGCAGATGCTGTTGCTGCACAGATCCTGTCAC
TGCTGCCATTGAAGTTTTTTCCAATCATCGTCATTGGGATCATTGCATTGATATTAGCACTGG
CCATTGGTCTGGGCATCCACTTCGACTGCTCAGGGAAGTACAGATGTCGCTCATCCTTTAAGT
GTATCGAGCTGATAGCTCGATGTGACGGAGTCTCGGATTGCAAAGACGGGGAGGACGAGTACC
GCTGTGTCCGGGTGGGTGGTCAGAATGCCGTGCTCCAGGTGTTCACAGCTGCTTCGTGGAAGA
CCATGTGCTCCGATGACTGGAAGGGTCACTACGCAAATGTTGCCTGTGCCCAACTGGGTTTCC
CAAGCTATGTGAGTTCAGATAACCTCAGAGTGAGCTCGCTGGAGGGGCAGTTCCGGGAGGAGT
TTGTGTCCATCGATCACCTCTTGCCAGATGACAAGGTGACTGCATTACACCACTCAGTATATG
TGAGGGAGGGATGTGCCTCTGGCCACGTGGTTACCTTGCAGTGCACAGCCTGTGGTCATAGAA
GGGGCTACAGCTCACGCATCGTGGGTGGAAACATGTCCTTGCTCTCGCAGTGGCCCTGGCAGG
CCAGCCTTCAGTTCCAGGGCTACCACCTGTGCGGGGGCTCTGTCATCACGCCCCTGTGGATCA
TCACTGCTGCACACTGTGTTTATGACTTGTACCTCCCCAAGTCATGGACCATCCAGGTGGGTC
TAGTTTCCCTGTTGGACAATCCAGCCCCATCCCACTTGGTGGAGAAGATTGTCTACCACAGCA
AGTACAAGCCAAAGAGGCTGGGCAATGACATCGCCCTTATGAAGCTGGCCGGGCCACTCACGT
TCAATGAAATGATCCAGCCTGTGTGCCTGCCCAACTCTGAAGAGAACTTCCCCGATGGAAAAG
TGTGCTGGACGTCAGGATGGGGGCCACAGAGGATGGAGGTGACGCCTCCCCTGTCCTGAACC
ACGCGGCCGTCCCTTTGATTTCCAACAAGATCTGCAACCACAGGGACGTGTACGGTGGCATCA
TCTCCCCCTCCATGCTCTGCGCGGGCTACCTGACGGGTGGCGTGGACAGCTGCCAGGGGGACA
GCGGGGGGCCCCTGGTGTGTCAAGAGAGGAGGCTGTGGAAGTTAGTGGGAGCGACCAGCTTTG
GCATCGGCTGCGCAGAGGTGAACAAGCCTGGGGTGTACACCCGTGTCACCTCCTTCCTGGACT
GGATCCACGAGCAGATGGAGAGAGACCTAAAAACCTGAAGAGGAAGGGGACAAGTAGCCACCT
GAGTTCCTGAGGTGATGAAGACAGCCCGATCCTCCCCTGGACTCCCGTGTAGGAACCTGCACA
CGAGCAGACACCCTTGGAGCTCTGAGTTCCGGCACCAGTAGCAGGCCCGAAAGAGGCACCCTT
CCATCTGATTCCAGCACAACCTTCAAGCTGCTTTTTGTTTTTTGTTTTTTTGAGGTGGAGTCT
CGCTCTGTTGCCCAGGCTGGAGTGCAGTGGCGAAATCCCTGCTCACTGCAGCCTCCGCTTCCC
TGGTTCAAGCGATTCTCTTGCCTCAGCTTCCCCAGTAGCTGGGACCACAGGTGCCCGCCACCA
CACCCAACTAATTTTTGTATTTTTAGTAGAGACAGGGTTTCACCATGTTGGCCAGGCTGCTCT
CAAACCCCTGACCTCAAATGATGTGCCTGCTTCAGCCTCCCACAGTGCTGGGATTACAGGCAT
GGGCCACCACGCCTAGCCTCACGCTCCTTTCTGATCTTCACTAAGAACAAAAGAAGCAGCAAC
TTGCAAGGGCGGCCTTTCCCACTGGTCCATCTGGTTTTCTCTCCAGGGTCTTGCAAAATTCCT
GACGAGATAAGCAGTTATGTGACCTCACGTGCAAAGCCACCAACAGCCACTCAGAAAAGACGC
ACCAGCCCAGAAGTGCAGAACTGCAGTCACTGCACGTTTTCATCTCTAGGGACCAGAACCAAA
CCCACCCTTTCTACTTCCAAGACTTATTTCACATGTGGGGAGGTTAATCTAGGAATGACTCG
TTTAAGGCCTATTTTCATGATTTCTTTGTAGCATTTGGTGCTTGACGTATTATTGTCCTTTGA
TTCCAAATAATATGTTTCCTTCCCTCATTGTCTGGCGTGTCTGCGTGGACTGGTGACGTGAAT
CAAAATCATCCACTGAAA

FIGURE 64

></usr/seqdb2/sst/DNA/Dnaseqs.min/ss.DNA45234
><subunit 1 of 1, 453 aa, 1 stop
><MW: 49334, pI: 6.32, NX(S/T): 1
MGENDPPAVEAPFSFRSLFGLDDLKISPVAPDADAVAAQILSLLPLKFFPIIVIGIIALILAL
AIGLGIHFDCSGKYRCRSSFKCIELIARCDGVSDCKDGEDEYRCVRVGGQNAVLQVFTAASWK
TMCSDDWKGHYANVACAQLGFPSYVSSDNLRVSSLEGQFREEFVSIDHLLPDDKVTALHHSVY
VREGCASGHVVTLQCTACGHRRGYSSRIVGGNMSLLSQWPWQASLQFQGYHLCGGSVITPLWI
ITAAHCVYDLYLPKSWTIQVGLVSLLDNPAPSHLVEKIVYHSKYKPKRLGNDIALMKLAGPLT
FNEMIQPVCLPNSEENFPDGKVCWTSGWGATEDGGDASPVLNHAAVPLISNKICNHRDVYGGI
ISPSMLCAGYLTGGVDSCQGDSGGPLVCQERRLWKLVGATSFGIGCAEVNKPGVYTRVTSFLD
WIHEQMERDLKT

Signal Peptide:
amino acids 1-20

Transmembrane domain:
amino acids 240-284

FIGURE 65

CGGGCCAGCCTGGGGCGGCCGGCCAGGAACCACCCGTTAAGGTGTCTTCTCTTTAGGGATGGT
GAGGTTGGAAAAAGACTCCTGTAACCCTCCTCCAGGATGAACCACCTGCCAGAAGACATGGAG
AACGCTCTCACCGGGAGCCAGAGCTCCCATGCTTCTCTGCGCAATATCCATTCCATCAACCCC
ACACAACTCATGGCCAGGATTGAGTCCTATGAAGGAAGGGAAAAGAAAGGCATATCTGATGTC
AGGAGGACTTTCTGTTTGTTTGTCACCTTTGACCTCTTATTCGTAACATTACTGTGGATAATA
GAGTTAAATGTGAATGGAGGCATTGAGAACACATTAGAGAAGGAGGTGATGCAGTATGACTAC
TATTCTTCATATTTTGATATATTTCTTCTGGCAGTTTTTCGATTTAAAGTGTTAATACTTGCA
TATGCTGTGTGCAGACTGCGCCATTGGTGGGCAATAGCGTTGACAACGGCAGTGACCAGTGCC
TTTTTACTAGCAAAAGTGATCCTTTCGAAGCTTTTCTCTCAAGGGGCTTTTGGCTATGTGCTG
CCCATCATTTCATTCATCCTTGCCTGGATTGAGACGTGGTTCCTGGATTTCAAAGTGTTACCT
CAAGAAGCAGAAGAAGAAAACAGACTCCTGATAGTTCAGGATGCTTCAGAGAGGGCAGCACTT
ATACCTGGTGGTCTTTCTGATGGTCAGTTTTATTCCCCTCCTGAATCCGAAGCAGGATCTGAA
GAAGCTGAAGAAAAACAGGACAGTGAGAAACCACTTTTAGAACTATGAGTACTACTTTTGTTA
AATGTGAAAAACCCTCACAGAAAGTCATCGAGGCAAAAAGAGGCAGGCAGTGGAGTCTCCCTG
TCGACAGTAAAGTTGAAATGGTGACGTCCACTGCTGGCTTTATTGAACAGCTAATAAAGATTT
ATTTATTGTAATACCTCACAAACGTTGTACCATATCCATGCACATTTAGTTGCCTGCCTGTGG
CTGGTAAGGTAATGTCATGATTCATCCTCTCTTCAGTGAGACTGAGCCTGATGTGTTAACAAA
TAGGTGAAGAAAGTCTTGTGCTGTATTCCTAATCAAAAGACTTAATATATTGAAGTAACACTT
TTTTAGTAAGCAAGATACCTTTTTATTTCAATTCACAGAATGGAATTTTTTTGTTTCATGTCT
CAGATTTATTTTGTATTTCTTTTTTAACACTCTACATTTCCCTTGTTTTTTAACTCATGCACA
TGTGCTCTTTGTACAGTTTTAAAAAGTGTAATAAAATCTGACATGTCAATGTGGCTAGTTTTA
TTTTTCTTGTTTTGCATTATGTGTATGGCCTGAAGTGTTGGACTTGCAAAAGGGGAAGAAAGG
AATTGCGAATACATGTAAAATGTCACCAGACATTTGTATTATTTTTATCATGAAATCATGTTT
TTCTCTGATTGTTCTGAAATGTTCTAAATACTCTTATTTTGAATGCACAAAATGACTTAAACC
ATTCATATCATGTTTCCTTTGCGTTCAGCCAATTTCAATTAAAATGAACTAAATTAAAAA

FIGURE 66

MNHLPEDMENALTGSQSSHASLRNIHSINPTQLMARIESYEGREKKGISDVRRTFCLFVTFDL
LFVTLLWIIELNVNGGIENTLEKEVMQYDYYSSYFDIFLLAVFRFKVLILAYAVCRLRHWWAI
ALTTAVTSAFLLAKVILSKLFSQGAFGYVLPIISFILAWIETWFLDFKVLPQEAEEENRLLIV
QDASERAALIPGGLSDGQFYSPPESEAGSEEAEEKQDSEKPLLEL

Important features of the protein:
Signal peptide:
amino acids 1-20

Transmembrane domains:
amino acids 54-72, 100-118, 130-144, 146-166

N-myristoylation sites.
amino acids 14-20, 78-84, 79-85, 202-208, 217-223

FIGURE 67

AATAAAGCTTCCTTAATGTTGTATATGTCTTTGAAGTACATCCGTGCATTTTTTTTTAGCATC
CAACCATTCCTCCCTTGTAGTTCTCGCCCCCTCAAATCACCCTCTCCCGTAGCCCACCCGACT
AACATCTCAGTCTCTGAAAATGCACAGAGATGCCTGGCTACCTCGCCCTGCCTTCAGCCTCAC
GGGGCTCAGTCTCTTTTTCTCTTTGGTGCCACCAGGACGGAGCATGGAGGTCACAGTACCTGC
CACCCTCAACGTCCTCAATGGCTCTGACGCCCGCCTGCCCTGCACCTTCAACTCCTGCTACAC
AGTGAACCACAAACAGTTCTCCCTGAACTGGACTTACCAGGAGTGCAACAACTGCTCTGAGGA
GATGTTCCTCCAGTTCCGCATGAAGATCATTAACCTGAAGCTGGAGCGGTTTCAAGACCGCGT
GGAGTTCTCAGGGAACCCCAGCAAGTACGATGTGTCGGTGATGCTGAGAAACGTGCAGCCGGA
GGATGAGGGGATTTACAACTGCTACATCATGAACCCCCCTGACCGCCACCGTGGCCATGGCAA
GATCCATCTGCAGGTCCTCATGGAAGAGCCCCCTGAGCGGGACTCCACGGTGGCCGTGATTGT
GGGTGCCTCCGTCGGGGGCTTCCTGGCTGTGGTCATCTTGGTGCTGATGGTGGTCAAGTGTGT
GAGGAGAAAAAAAGAGCAGAAGCTGAGCACAGATGACCTGAAGACCGAGGAGGAGGGCAAGAC
GGACGGTGAAGGCAACCCGGATGATGGCGCCAAGTAGTGGGTGGCCGGCCCTGCAGCCTCCCG
TGTCCCGTCTCCTCCCCTCTCCGCCCTGTACAGTGACCCTGCCTGCTCGCTCTTGGTGTGCTT
CCCGTGACCTAGGACCCCAGGGCCCACCTGGGGCCTCCTGAACCCCCGACTTCGTATCTCCCA
CCCTGCACCAAGAGTGACCCACTCTCTTCCATCCGAGAAACCTGCCATGCTCTGGGACGTGTG
GGCCCTGGGGAGAGGAGAGAAAGGGCTCCCACCTGCCAGTCCCTGGGGGGAGGCAGGAGGCAC
ATGTGAGGGTCCCCAGAGAGAAGGGAGTGGGTGGGCAGGGGTAGAGGAGGGGCCGCTGTCACC
TGCCCAGTGCTTGCCTGGCAGTGGCTTCAGAGAGGACCTGGTGGGGAGGGAGGGCTTTCCTGT
GCTGACAGCGCTCCCTCAGGAGGGCCTTGGCCTGGCACGGCTGTGCTCCTCCCCTGCTCCCAG
CCCAGAGCAGCCATCAGGCTGGAGGTGACGATGAGTTCCTGAAACTTGGAGGGGCATGTTAAA
GGGATGACTGTGCATTCCAGGGCACTGACGGAAAGCCAGGGCTGCAGGCAAAGCTGGACATGT
GCCCTGGCCCAGGAGGCCATGTTGGGCCCTCGTTTCCATTGCTAGTGGCCTCCTTGGGGCTCC
TGTTGGCTCCTAATCCCTTAGGACTGTGGATGAGGCCAGACTGGAAGAGCAGCTCCAGGTAGG
GGGCCATGTTTCCCAGCGGGGACCCACCAACAGAGGCCAGTTTCAAAGTCAGCTGAGGGGCTG
AGGGGTGGGGCTCCATGGTGAATGCAGGTTGCTGCAGGCTCTGCCTTCTCCATGGGGTAACCA
CCCTCGCCTGGGCAGGGGCAGCCAAGGCTGGGAAATGAGGAGGCCATGCACAGGGTGGGGCAG
CTTTCTTTGGGGCTTCAGTGAGAACTCTCCCAGTTGCCCTTGGTGGGGTTTCCACCTGGCTTT
TGGCTACAGAGAGGGAAGGGAAAGCCTGAGGCCGGCATAAGGGGAGGCCTTGGAACCTGAGCT
GCCAATGCCAGCCCTGTCCCATCTGCGGCCACGCTACTCGCTCCTCTCCCAACAACTCCCTTC
GTGGGGACAAAAGTGACAATTGTAGGCCAGGCACAGTGGCTCACGCCTGTAATCCCAGCACTT
TGGGAGGCCAAGGCGGGTGGATTACCTCCATCTGTTTAGTAGAAATGGGCAAAACCCCATCTC
TACTAAAAATACAAGAATTAGCTGGGCGTGGTGGCGTGTGCCTGTAATCCCAGCTATTTGGGA
GGCTGAGGCAGGAGAATCGCTTGAGCCCGGGAAGCAGAGGTTGCAGTGAACTGAGATAGTGAT
AGTGCCACTGCAATTCAGCCTGGGTGACATAGAGAGACTCCATCTCAAAAAAAA

FIGURE 68

</usr/seqdb2/sst/DNA/Dnaseqs.min/ss.DNA45415
<subunit 1 of 1, 215 aa, 1 stop
<MW: 24326, pI: 6.32, NX(S/T): 4
MHRDAWLPRPAFSLTGLSLFFSLVPPGRSMEVTVPATLNVLNGSDARLPCTFNSCYTVNHKQF
SLNWTYQECNNCSEEMFLQFRMKIINLKLERFQDRVEFSGNPSKYDVSVMLRNVQPEDEGIYN
CYIMNPPDRHRGHGKIHLQVLMEEPPERDSTVAVIVGASVGGFLAVVILVLMVVKCVRRKKEQ
KLSTDDLKTEEEGKTDGEGNPDDGAK

Important features:
Signal peptide:
amino acids 1-20

Transmembrane domain:
amino acids 161-179

Immunoglobulin-like fold:
amino acids 83-127

N-glycosylation sites.
amino acids 42-45, 66-69 and 74-77

FIGURE 69

GGCGCCTGGTTCTGCGCGTACTGGCTGTACGGAGCAGGAGCAAGAGGTCGCCGCCAGCCTCCGCCGCCGAGCCTC
GTTCGTGTCCCCGCCCCTCGCTCCTGCAGCTACTGCTCAGAAACGCTGGGGCGCCCACCCTGGCAGACTAACGAA
GCAGCTCCCTTCCCACCCCAACTGCAGGTCTAATTTTGGACGCTTTGCCTGCCATTTCTTCCAGGTTGAGGGAGC
CGCAGAGGCGGAGGCTCGCGTATTCCTGCAGTCAGCACCCACGTCGCCCCCGGACGCTCGGTGCTCAGGCCCTTC
GCGAGCGGGGCTCTCCGTCTGCGGTCCCTTGTGAAGGCTCTGGGCGGCTGCAGAGGCCGGCCGTCCGGTTTGGCT
CACCTCTCCCAGGAAACTTCACACTGGAGAGCCAAAAGGAGTGGAAGAGCCTGTCTTGGAGATTTTCCTGGGGAA
ATCCTGAGGTCATTCATTATGAAGTGTACCGCGCGGGAGTGGCTCAGAGTAACCACAGTGCTGTTCATGGCTAGA
GCAATTCCAGCCATGGTGGTTCCCAATGCCACTTTATTGGAGAAACTTTTGGAAAAATACATGGATGAGGATGGT
GAGTGGTGGATAGCCAAACAACGAGGGAAAAGGGCCATCACAGACAATGACATGCAGAGTATTTTGGACCTTCAT
AATAAATTACGAAGTCAGGTGTATCCAACAGCCTCTAATATGGAGTATATGACATGGGATGTAGAGCTGGAAAGA
TCTGCAGAATCCTGGGCTGAAAGTTGCTTGTGGAACATGGACCTGCAAGCTTGCTTCCATCAATTGGACAGAAT
TTGGGAGCACACTGGGGAAGATATAGGCCCCCGACGTTTCATGTACAATCGTGGTATGATGAAGTGAAAGACTTT
AGCTACCCATATGAACATGAATGCAACCCATATTGTCCATTCAGGTGTTCTGGCCCTGTATGTACACATTATACA
CAGGTCGTGTGGGCAACTAGTAACAGAATCGGTTGTGCCATTAATTTGTGTCATAACATGAACATCTGGGGGCAG
ATATGGCCCAAAGCTGTCTACCTGGTGTGCAATTACTCCCCAAAGGGAAACTGGTGGGGCCATGCCCCTTACAAA
CATGGGCGGCCCTGTTCTGCTTGCCCACCTAGTTTTGGAGGGGGCTGTAGAGAAAATCTGTGCTACAAAGAAGGG
TCAGACAGGTATTATCCCCCTCGAGAAGAGGAAACAAATGAAATAGAACGACAGCAGTCACAAGTCCATGACACC
CATGTCCGGACAAGATCAGATGATAGTAGCAGAAATGAAGTCATAAGCGCACAGCAAATGTCCCAAATTGTTTCT
TGTGAAGTAAGATTAAGAGATCAGTGCAAAGGAACAACCTGCAATAGGTACGAATGTCCTGCTGGCTGTTTGGAT
AGTAAAGCTAAAGTTATTGGCAGTGTACATTATGAAATGCAATCCAGCATCTGTAGAGCTGCAATTCATTATGGT
ATAATAGACAATGATGGTGGCTGGGTAGATATCACTAGACAAGGAAGAAAGCATTATTTCATCAAGTCCAATAGA
AATGGTATTCAAACAATTGGCAAATATCAGTCTGCTAATTCCTTCACAGTCTCTAAAGTAACAGTTCAGGCTGTG
ACTTGTGAAACAACTGTGGAACAGCTCTGTCCATTTCATAAGCCTGCTTCACATTGCCCAAGAGTATACTGTCCT
CGTAACTGTATGCAAGCAAATCCACATTATGCTCGTGTAATTGGAACTCGAGTTTATTCTGATCTGTCCAGTATC
TGCAGAGCAGCAGTACATGCTGGAGTGGTTCGAAATCACGGTGGTTATGTTGATGTAATGCCTGTGGACAAAAGA
AAGACCTACATTGCTTCTTTTCAGAATGGAATCTTCTCAGAAAGTTTACAGAATCCTCCAGGAGGAAAGGCATTC
AGAGTGTTTGCTGTTGTGTGAAACTGAATACTTGGAAGAGGACCATAAAGACTATTCCAAATGCAATATTTCTGA
ATTTTGTATAAAACTGTAACATTACTGTACAGAGTACATCAACTATTTTCAGCCCAAAAAGGTGCCAAATGCATA
TAAATCTTGATAAACAAAGTCTATAAAATAAAACATGGGACATTAGCTTTGGGAAAAGTAATGAAAATATAATGG
TTTTAGAAATCCTGTGTTAAATATTGCTATATTTTCTTAGCAGTTATTTCTACAGTTAATTACATAGTCATGATT
GTTCTACGTTTCATATATTATATGGTGCTTTGTATATGCCACTAATAAAATGAATCTAAACATTGAATGTGAATG
GCCCTCAGAAAATCATCTAGTGCATTTAAAAATAATCGACTCTAAAACTGAAAGAAACCTTATCACATTTTCCCC
AGTTCAATGCTATGCCATTACCAACTCCAAATAATCTCAAATAATTTTCCACTTAATAACTGTAAAGTTTTTTTC
TGTTAATTTAGGCATATAGAATATTAAATTCTGATATTGCACTTCTTATTTTATATAAAATAATCCTTTAATATC
CAAATGAATCTGTTAAAATGTTTGATTCCTTGGGAATGGCCTTAAAAATAAATGTAATAAAGTCAGAGTGGTGGT
ATGAAAACATTCCTAGTGATCATGTAGTAAATGTAGGGTTAAGCATGGACAGCCAGAGCTTTCTATGTACTGTTA
AAATTGAGGTCACATATTTTCTTTTGTATCCTGGCAAATACTCCTGCAGGCCAGGAAGTATAATAGCAAAAAGTT
GAACAAAGATGAACTAATGTATTACATTACCATTGCCACTGATTTTTTTTAAATGGTAAATGACCTTGTATATAA
ATATTGCCATATCATGGTACCTATAATGGTGATATATTTGTTTCTATGAAAAATGTATTGTGCTTTGATACTAAA
AATCTGTAAAATGTTAGTTTTGGTAATTTTTTTTCTGCTGGTGGATTTACATATTAAATTTTTTCTGCTGGTGGA
TAAACATTAAAATTAATCATGTTTCAAAAAAAAAAAAA

FIGURE 70

</usr/seqdb2/sst/DNA/Dnaseqs.min/ss.DNA45417
<subunit 1 of 1, 500 aa, 1 stop
<MW: 56888, pI: 8.53, NX(S/T): 2
MKCTAREWLRVTTVLFMARAIPAMVVPNATLLEKLLEKYMDEDGEWWIAKQRGKRAITDNDMQ
SILDLHNKLRSQVYPTASNMEYMTWDVELERSAESWAESCLWEHGPASLLPSIGQNLGAHWGR
YRPPTFHVQSWYDEVKDFSYPYEHECNPYCPFRCSGPVCTHYTQVVWATSNRIGCAINLCHNM
NIWGQIWPKAVYLVCNYSPKGNWWGHAPYKHGRPCSACPPSFGGGCRENLCYKEGSDRYYPPR
EEETNEIERQQSQVHDTHVRTRSDDSSRNEVISAQQMSQIVSCEVRLRDQCKGTTCNRYECPA
GCLDSKAKVIGSVHYEMQSSICRAAIHYGIIDNDGGWVDITRQGRKHYFIKSNRNGIQTIGKY
QSANSFTVSKVTVQAVTCETTVEQLCPFHKPASHCPRVYCPRNCMQANPHYARVIGTRVYSDL
SSICRAAVHAGVVRNHGGYVDVMPVDKRKTYIASFQNGIFSESLQNPPGGKAFRVFAVV

Important features:
Signal peptide:
amino acids 1-20

Extracellular proteins SCP/Tpx-1/Ag5/PR-1/Sc7 protein
amino acids 165-186, 196-218, 134-146, 96-108 and 58-77

N-glycosylation site
amino acids 28-31

FIGURE 71

CAGCCCCGCGCGCCGGCCGAGTCGCTGAGCCGCGGCTGCCGGACGGGACGGGACCGGCTAGGC
TGGGCGCGCCCCCCGGGCCCCGCCGTGGGCATGGGCGCACTGGCCCGGGCGCTGCTGCTGCCT
CTGCTGGCCCAGTGGCTCCTGCGCGCCGCCCCGGAGCTGGCCCCCGCGCCCTTCACGCTGCCC
CTCCGGGTGGCCGCGGCCACGAACCGCGTAGTTGCGCCCACCCCGGGACCCGGGACCCCTGCC
GAGCGCCACGCCGACGGCTTGGCGCTCGCCCTGGAGCCTGCCCTGGCGTCCCCCGCGGGCGCC
GCCAACTTCTTGGCCATGGTAGACAACCTGCAGGGGGACTCTGGCCGCGGCTACTACCTGGAG
ATGCTGATCGGGACCCCCCCGCAGAAGCTACAGATTCTCGTTGACACTGGAAGCAGTAACTTT
GCCGTGGCAGGAACCCCGCACTCCTACATAGACACGTACTTTGACACAGAGAGGTCTAGCACA
TACCGCTCCAAGGGCTTTGACGTCACAGTGAAGTACACACAAGGAAGCTGGACGGGCTTCGTT
GGGGAAGACCTCGTCACCATCCCCAAAGGCTTCAATACTTCTTTTCTTGTCAACATTGCCACT
ATTTTTGAATCAGAGAATTTCTTTTTGCCTGGGATTAAATGGAATGGAATACTTGGCCTAGCT
TATGCCACACTTGCCAAGCCATCAAGTTCTCTGGAGACCTTCTTCGACTCCCTGGTGACACAA
GCAAACATCCCCAACGTTTTCTCCATGCAGATGTGTGGAGCCGGCTTGCCCGTTGCTGGATCT
GGGACCAACGGAGGTAGTCTTGTCTTGGGTGGAATTGAACCAAGTTTGTATAAAGGAGACATC
TGGTATACCCCTATTAAGGAAGAGTGGTACTACCAGATAGAAATTCTGAAATTGGAAATTGGA
GGCCAAAGCCTTAATCTGGACTGCAGAGAGTATAACGCAGACAAGGCCATCGTGGACAGTGGC
ACCACGCTGCTGCGCCTGCCCCAGAAGGTGTTTGATGCGGTGGTGGAAGCTGTGGCCCGCGCA
TCTCTGATTCCAGAATTCTCTGATGGTTTCTGGACTGGGTCCCAGCTGGCGTGCTGGACGAAT
TCGGAAACACCTTGGTCTTACTTCCCTAAAATCTCCATCTACCTGAGAGACGAGAACTCCAGC
AGGTCATTCCGTATCACAATCCTGCCTCAGCTTTACATTCAGCCCATGATGGGGGCCGGCCTG
AATTATGAATGTTACCGATTCGGCATTTCCCCATCCACAAATGCGCTGGTGATCGGTGCCACG
GTGATGGAGGGCTTCTACGTCATCTTCGACAGAGCCCAGAAGAGGGTGGGCTTCGCAGCGAGC
CCCTGTGCAGAAATTGCAGGTGCTGCAGTGTCTGAAATTTCCGGGCCTTTCTCAACAGAGGAT
GTAGCCAGCAACTGTGTCCCCGCTCAGTCTTTGAGCGAGCCCATTTTGTGGATTGTGTCCTAT
GCGCTCATGAGCGTCTGTGGAGCCATCCTCCTTGTCTTAATCGTCCTGCTGCTGCTGCCGTTC
CGGTGTCAGCGTCGCCCCCGTGACCCTGAGGTCGTCAATGATGAGTCCTCTCTGGTCAGACAT
CGCTGGAAATGAATAGCCAGGCCTGACCTCAAGCAACCATGAACTCAGCTATTAAGAAAATCA
CATTTCCAGGGCAGCAGCCGGGATCGATGGTGGCGCTTTCTCCTGTGCCCACCCGTCTTCAAT
CTCTGTTCTGCTCCCAGATGCCTTCTAGATTCACTGTCTTTTGATTCTTGATTTTCAAGCTTT
CAAATCCTCCCTACTTCCAAGAAAAATAATTAAAAAAAAAACTTCATTCTAA

FIGURE 72

></usr/seqdb2/sst/DNA/Dnaseqs.min/ss.DNA45493
><subunit 1 of 1, 518 aa, 1 stop
><MW: 56180, pI: 5.08, NX(S/T): 2
MGALARALLLPLLAQWLLRAAPELAPAPFTLPLRVAAATNRVVAPTPGPGTPAERHADGLALA
LEPALASPAGAANFLAMVDNLQGDSGRGYYLEMLIGTPPQKLQILVDTGSSNFAVAGTPHSYI
DTYFDTERSSTYRSKGFDVTVKYTQGSWTGFVGEDLVTIPKGFNTSFLVNIATIFESENFFLP
GIKWNGILGLAYATLAKPSSSLETFFDSLVTQANIPNVFSMQMCGAGLPVAGSGTNGGSLVLG
GIEPSLYKGDIWYTPIKEEWYYQIEILKLEIGGQSLNLDCREYNADKAIVDSGTTLLRLPQKV
FDAVVEAVARASLIPEFSDGFWTGSQLACWTNSETPWSYFPKISIYLRDENSSRSFRITILPQ
LYIQPMMGAGLNYECYRFGISPSTNALVIGATVMEGFYVIFDRAQKRVGFAASPCAEIAGAAV
SEISGPFSTEDVASNCVPAQSLSEPILWIVSYALMSVCGAILLVLIVLLLLPFRCQRRPRDPE
VVNDESSLVRHRWK

Important features:
Signal peptide:
amino acids 1-20

Transmembrane domain:
amino acids 466-494

N-glycosylation sites.
amino acids 170-173 and 366-369

Leucine zipper pattern.
amino acids 10-31 and 197-118

Eukaryotic and viral aspartyl proteases
amino acids 109-118, 252-261 and 298-310

FIGURE 73

GCCGCGGCGAGAGCGCGCCCAGCCCCGCCGCGATGCCCGCGCGCCCAGGACGCCTCCTCCCGCTGCTGGCCCGGC
CGGCGGCCCTGACTGCGCTGCTGCTGCTGCTGCTGGGCCATGGCGGCGGCGGGCGCTGGGGCGCCCGGGCCCAGG
AGGCGGCGGCGGCGGCGGCGGACGGGCCCCCCGCGGCAGACGGCGAGGACGGACAGGACCCGCACAGCAAGCACC
TGTACACGGCCGACATGTTCACGCACGGGATCCAGAGCGCCGCGCACTTCGTCATGTTCTTCGCGCCCTGGTGTG
GACACTGCCAGCGGCTGCAGCCGACTTGGAATGACCTGGGAGACAAATACAACAGCATGGAAGATGCCAAAGTCT
ATGTGGCTAAAGTGGACTGCACGGCCCACTCCGACGTGTGCTCCGCCCAGGGGGTGCGAGGATACCCCACCTTAA
AGCTTTTCAAGCCAGGCCAAGAAGCTGTGAAGTACCAGGGTCCTCGGGACTTCCAGACACTGGAAAACTGGATGC
TGCAGACACTGAACGAGGAGCCAGTGACACCAGAGCCGGAAGTGGAACCGCCCAGTGCCCCCGAGCTCAAGCAAG
GGCTGTATGAGCTCTCAGCAAGCAACTTTGAGCTGCACGTTGCACAAGGCGACCACTTTATCAAGTTCTTCGCTC
CGTGGTGTGGTCACTGCAAAGCCCTGGCTCCAACCTGGGAGCAGCTGGCTCTGGGCCTTGAACATTCCGAAACTG
TCAAGATTGGCAAGGTTGATTGTACACAGCACTATGAACTCTGCTCCGGAAACCAGGTTCGTGGCTATCCCACTC
TTCTCTGGTTCCGAGATGGGAAAAAGGTGGATCAGTACAAGGGAAAGCGGGATTTGGAGTCACTGAGGGAGTACG
TGGAGTCGCAGCTGCAGCGCACAGAGACTGGAGCGACGGAGACCGTCACGCCCTCAGAGGCCCCGGTGCTGGCAG
CTGAGCCCGAGGCTGACAAGGGCACTGTGTTGGCACTCACTGAAAATAACTTCGATGACACCATTGCAGAAGGAA
TAACCTTCATCAAGTTTTATGCTCCATGGTGTGGTCATTGTAAGACTCTGGCTCCTACTTGGGAGGAACTCTCTA
AAAAGGAATTCCCTGGTCTGGCGGGGGTCAAGATCGCCGAAGTAGACTGCACTGCTGAACGGAATATCTGCAGCA
AGTATTCGGTACGAGGCTACCCCACGTTATTGCTTTTCCGAGGAGGGAAGAAAGTCAGTGAGCACAGTGGAGGCA
GAGACCTTGACTCGTTACACCGCTTTGTCCTGAGCCAAGCGAAAGACGAACTTTAGGAACACAGTTGGAGGTCAC
CTCTCCTGCCCAGCTCCCGCACCCTGCGTTTAGGAGTTCAGTCCCACAGAGGCCACTGGGTTCCCAGTGGTGGCT
GTTCAGAAAGCAGAACATACTAAGCGTGAGGTATCTTCTTTGTGTGTGTGTTTTCCAAGCCAACACACTCTACAG
ATTCTTTATTAAGTTAAGTTTCTCTAAGTAAATGTGTAACTCATGGTCACTGTGTAAACATTTTCAGTGGCGATA
TATCCCCTTTGACCTTCTCTTGATGAAATTTACATGGTTTCCTTTGAGACTAAAATAGCGTTGAGGGAAATGAAA
TTGCTGGACTATTTGTGGCTCCTGAGTTGAGTGATTTTGGTGAAAGAAAGCACATCCAAAGCATAGTTTACCTGC
CCACGAGTTCTGGAAAGGTGGCCTTGTGGCAGTATTGACGTTCCTCTGATCTTAAGGTCACAGTTGACTCAATAC
TGTGTTGGTCCGTAGCATGGAGCAGATTGAAATGCAAAAACCCACACCTCTGGAAGATACCTTCACGGCCGCTGC
TGGAGCTTCTGTTGCTGTGAATACTTCTCTCAGTGTGAGAGGTTAGCCGTGATGAAAGCAGCGTTACTTCTGACC
GTGCCTGAGTAAGAGAATGCTGATGCCATAACTTTATGTGTCGATACTTGTCAAATCAGTTACTGTTCAGGGGAT
CCTTCTGTTTCTCACGGGGTGAAACATGTCTTTAGTTCCTCATGTTAACACGAAGCCAGAGCCCACATGAACTGT
TGGATGTCTTCCTTAGAAAGGGTAGGCATGGAAAATTCCACGAGGCTCATTCTCAGTATCTCATTAACTCATTGA
AAGATTCCAGTTGTATTTGTCACCTGGGGTGACAAGACCAGACAGGCTTTCCCAGGCCTGGGTATCCAGGGAGGC
TCTGCAGCCCTGCTGAAGGGCCCTAACTAGAGTTCTAGAGTTTCTGATTCTGTTTCTCAGTAGTCCTTTTAGAGG
CTTGCTATACTTGGTCTGCTTCAAGGAGGTCGACCTTCTAATGTATGAAGAATGGGATGCATTTGATCTCAAGAC
CAAAGACAGATGTCAGTGGGCTGCTCTGGCCCTGGTGTGCACGGCTGTGGCAGCTGTTGATGCCAGTGTCCTCTA
ACTCATGCTGTCCTTGTGATTAAACACCTCTATCTCCCTTGGGAATAAGCACATACAGGCTTAAGCTCTAAGATA
GATAGGTGTTTGTCCTTTTACCATCGAGCTACTTCCCATAATAACCACTTTGCATCCAACACTCTTCACCCACCT
CCCATACGCAAGGGGATGTGGATACTTGGCCCAAAGTAACTGGTGGTAGGAATCTTAGAAACAAGACCACTTATA
CTGTCTGTCTGAGGCAGAAGATAACAGCAGCATCTCGACCAGCCTCTGCCTTAAAGGAAATCTTTATTAATCACG
TATGGTTCACAGATAATTCTTTTTTTAAAAAAACCCAACCTCCTAGAGAAGCACAACTGTCAAGAGTCTTGTACA
CACAACTTCAGCTTTGCATCACGAGTCTTGTATTCCAAGAAAATCAAAGTGGTACAATTTGTTTGTTTACACTAT
GATACTTTCTAAATAAACTCTTTTTTTTTAA

FIGURE 74

></usr/seqdb2/sst/DNA/Dnaseqs.min/ss.DNA46776
><subunit 1 of 1, 432 aa, 1 stop
><MW: 47629, pI: 5.90, NX(S/T): 0
MPARPGRLLPLLARPAALTALLLLLLGHGGGGRWGARAQEAAAAAADGPPAADGEDGQDPHSK
HLYTADMFTHGIQSAAHFVMFFAPWCGHCQRLQPTWNDLGDKYNSMEDAKVYVAKVDCTAHSD
VCSAQGVRGYPTLKLFKPGQEAVKYQGPRDFQTLENWMLQTLNEEPVTPEPEVEPPSAPELKQ
GLYELSASNFELHVAQGDHFIKFFAPWCGHCKALAPTWEQLALGLEHSETVKIGKVDCTQHYE
LCSGNQVRGYPTLLWFRDGKKVDQYKGKRDLESLREYVESQLQRTETGATETVTPSEAPVLAA
EPEADKGTVLALTENNFDDTIAEGITFIKFYAPWCGHCKTLAPTWEELSKKEFPGLAGVKIAE
VDCTAERNICSKYSVRGYPTLLLFRGGKKVSEHSGGRDLDSLHRFVLSQAKDEL

Signal sequence:
amino acids 1-32

FIGURE 75A

CGGACGCGTGGGCGGACGCGTGGGCAAAAGAACTCGGAGTGCCAAAGCTAAATAAGTTAGCTGAGAAAACGCACG
CAGTTTGCAGCGCCTGCGCCGGGTGCGCCAACTACGCAAAGACCAAGCGGGCTCCGCGCGGACCGGCCGCGGGGC
TAGGGACCCGGCTTTGGCCTTCAGGCTCCCTAGCAGCGGGGAAAAGGAATTGCTGCCCCGGAGTTTCTGCGGAGGT
GGAGGGAGATCAGGAAACGGCTTCTTCCTCACTTCGCCGCCTGGTGAGTGTCGGGGAGATTGGCAAACGCCTAGG
AAAGGACTGGGGAAAATAGCCCTGGGAAAGTGGAGAAGGTGATCAGGAGGCCGGTCCACTACGGCAGTTTATCTG
TCTGATCAGAGCCAGACGCGACGCGTCCACTTCGCAGTTCTTTCCAGGTGTGGGGACCGCAGGACAGACGGCCGA
TCCCGCCGCCCTCCGTACCAGCACTCCCAGGAGAGTCAGCCTCGCTCCCCAACGTCGAGGGCGCTCTGGCCACGA
AAAGTTCCTGTCCACTGTGATTCTCAATTCCTTGCTTGGTTTTTTTCTCCAGAGAACTTTTGGGTGGAGATATTA
ACTTTTTTCTTTTTTTTTTTCCTTGGTGGAAGCTGCTCTAGGGAGGGGGGAGGAGGAGGAGAAAGTGAAATGTGC
TGGAGAAGAGCGAGCCCTCCTTGTTCTTCCGGAGTCCCATCCATTAAGCCATCACTTCTGGAAGATTAAAGTTGT
CGGACATGGTGACAGCTGAGAGGAGAGGAGGATTTCTTGCCAGGTGGAGAGTCTTCACCGTCTGTTGGGTGCATG
TGTGCGCCCGCAGCGGCGCGGGGCGCGTGGTTCTCCGCGTGGAGTCTCACCTGGGACCTGAGTGAATGGCTCCCA
GGGGCTGTGCGGGGCATCCGCCTCCGCCTTCTCCACAGGCCTGTGTCTGTCCTGGAAAGATGCTAGCAATGGGGG
CGCTGGCAGGATTCTGGATCCTCTGCCTCCTCACTTATGGTTACCTGTCCTGGGGCCAGGCCTTAGAAGAGGAGG
AAGAAGGGGCCTTACTAGCTCAAGCTGGAGAGAAACTAGAGCCCAGCACAACTTCCACCTCCCAGCCCCATCTCA
TTTTCATCCTAGCGGATGATCAGGGATTTAGAGATGTGGGTTACCACGGATCTGAGATTAAAACACCTACTCTTG
ACAAGCTCGCTGCCGAAGGAGTTAAACTGGAGAACTACTATGTCCAGCCTATTTGCACACCATCCAGGAGTCAGT
TTATTACTGGAAAGTATCAGATACACACCGGACTTCAACATTCTATCATAAGACCTACCCAACCCAACTGTTTAC
CTCTGGACAATGCCACCCTACCTCAGAAACTGAAGGAGGTTGGATATTCAACGCATATGGTCGGAAAATGGCACT
TGGGTTTTAACAGAAAAGAATGCATGCCCACCAGAAGAGGATTTGATACCTTTTTTGGTTCCCTTTTGGGAAGTG
GGGATTACTATACACACTACAAATGTGACAGTCCTGGGATGTGTGGCTATGACTTGTATGAAAACGACAATGCTG
CCTGGGACTATGACAATGGCATATACTCCACACAGATGTACACTCAGAGAGTACAGCAAATCTTAGCTTCCCATA
ACCCCACAAAGCCTATATTTTTATATACTGCCTATCAAGCTGTTCATTCACCACTGCAAGCTCCTGGCAGGTATT
TCGAACACTACCGATCCATTATCAACATAAACAGGAGAAGATATGCTGCCATGCTTTCCTGCTTAGATGAAGCAA
TCAACAACGTGACATTGGCTCTAAAGACTTATGGTTTCTATAACAACAGCATTATCATTTACTCTTCAGATAATG
GTGGCCAGCCTACGGCAGGAGGGAGTAACTGGCCTCTCAGAGGTAGCAAAGGAACATATTGGGAAGGAGGGATCC
GGGCTGTAGGCTTTGTGCATAGCCCACTTCTGAAAAACAAGGGAACAGTGTGTAAGGAACTTGTGCACATCACTG
ACTGGTACCCCACTCTCATTTCACTGGCTGAAGGACAGATTGATGAGGACATTCAACTAGATGGCTATGATATCT
GGGAGACCATAAGTGAGGGTCTTCGCTCACCCCGAGTAGATATTTTGCATAACATTGACCCCTATACACCAAGGC
AAAAAATGGCTCCTGGGCAGCAGGCTATGGGATCTGGAACACTGCAATCCAGTCAGCCATCAGAGTGCAGCACTG
GAAATTGCTTACAGGAAATCCTGGCTACAGCGACTGGGTCCCCCCTCAGTCTTTCAGCAACCTGGGACCGAACCG
GTGGCACAATGAACGGATCACCTTGTCAACTGGCAAAAGTGTATGGCTTTTCAACATCACAGCCGACCCATATGA
GAGGGTGGACCTATCTAACAGGTATCCAGGAATCGTGAAGAAGCTCCTACGGAGGCTCTCACAGTTCAACAAAAC
TGCAGTGCCGGTCAGGTATCCCCCCAAAGACCCCAGAAGTAACCCTAGGCTCAATGGAGGGGTCTGGGGACCATG
GTATAAAGAGGAAACCAAGAAAAAGAAGCCAAGCAAAAATCAGGCTGAGAAAAAGCAAAAGAAAAGCAAAAAAAA
GAAGAAGAAACAGCAGAAAGCAGTCTCAGGTAAACCAGCAAATTTGGCTCGATAATATCGCTGGCCTAAGCGTCA
GGCTTGTTTTCATGCTGTGCCACTCCAGAGACTTCTGCCACCTGGCCGCCACACTGAAAACTGTCCTGCTCAGTG
CCAAGGTGCTACTCTTGCAAGCCACACTTAGAGAGAGTGGAGATGTTTATTTCTCTCGCTCCTTTAGAAAACGTG
GTGAGTCCTGAGTTCCACTGCTGTGCTTCAGTCAACTGACCAAACACTGCTTTGAATTATAGGAGGAGAACAATA
ACCTACCATCCGCAAGCATGCTAATTTGATGGAAGTTACAGGGTAGCATGATTAAAACTACCTTTGATAAATTAC
AGTCAAAGATTGTGTCACCTCAAAGGCCTTGAAGAATATATTTTCTTGGTGAATTTTTGTATGTCTGTCATATGA
CACTTGGGTTTTTTAATTAATTCTATTTTATATATATAAATATATGTTTCTTTTCCTGTGAAAAGCTGTTTTTCT
CACATGTGAACAGCTTGCACCTCATTTTACCATGCGTGAGGGAATGGCAAATAAGAATGTTTGAGCACACTGCCC
ACAATGAATGTAACTATTTTCTAAACACTTTACTAGAAGAACATTTCAGTATAAAAAACCTAATTTATTTTTACA
GAAAAATATTTTGTTGTTTTTATAAAAAGTTATGCAAATGACTTTTATTTTTATTTCCTGCATACCATTAGAAGA
ATTTTATTTCATTTCTTCAAATTATCAAGCACTGTAATACTATAAATTAATGTAATACTGTGTGAATTCAGACTA
TAAAAAACATCATTCAGAAAACTTTATAATCGTCATTGTTCAATCAAGATTTTGAATGTAATAAGATGAATATAT
ATTACTTGGAAATTCAATGTTTGTGCAGAGTTGAGACAACTTTATTGTTTCTATCATAAACTATTTATGTATCTT
AATTATTAAAATGATTTACTTTATGGCACTAGAAAATTTACTGTGGCTTTTCTGATCTAACTTCTAGCTAAAATT
GTATCATTGGTCCTAAAAAATAAAAATCTTTACTAATAGGCAATTGAAGGAATGGTTTGCTAACAACCACAGTAA
TATAATATGATTTTACAGATAGATGCTTCCCCTTGGCTATGACATGGAGAAAGATTTTCCCATAATAATAACTAA
TATTTATATTAGGTTGGTGCAAAACTAGTTGCGGTTTTTCCCATTAAAAGTAATAACCTTACTCTTATACAAAGT
GGACACTGTGGGGAGATACAGAGAAATGGAAGATACGGATCCTGCCTGGAGTAGGTAACCTTGCTTGGAAACCCC
ACATGCAAACGTCATGAGGAGAATTAAAGGAGTATTATCAGTAATGAAGTTTATCATGGGTCATCAATGAGCATA
GATTGGTGTGGATCCTGTAGACCCTGGTGTTTTCTTTGAAGTGCCCTCTCCTAATGCAGAGGCCTTGAAGCTTAC

FIGURE 75B

AGTATACACTTGAAAAGTCACAGATAGCTAGAATTATGATCTTTGAAGTTATAACTGTGATCTGAAAATGTGTGT
GGTGGTATGACAGCATACCATTAAATACATTTACATCACAGCTCAAAGGACTGTGATATAATCCATTTATATCAC
AACTCAAAGGACTGTGATATAATCCATTTATATCACAGCTCACAGTTTCTGAAAATGTATAAAAGAATCTATAAT
CTAGTACTGAAATTACTAAATTGGGTAAGATGATTTAAATGATTTTAATTTTAACATTTTATTTCTAGAATATAT
GGCTCCATTTTATTTTATAGTGTAAAGTTGTATTTCCTAAAGTTTGTGTTTTGTCGACAGTATCTTTTAAATGAG
TCTTAAAAATAAAGGCATATTGTTCATGTTTAAAAAAAAAAAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAAA

FIGURE 76

></usr/seqdb2/sst/DNA/Dnaseqs.min/ss.DNA48296
><subunit 1 of 1, 515 aa, 1 stop
><MW: 56885, pI: 6.49, NX(S/T): 5
MAPRGCAGHPPPPSPQACVCPGKMLAMGALAGFWILCLLTYGYLSWGQALEEEEEGALLAQAGEKLEPSTTSTSQ
PHLIFILADDQGFRDVGYHGSEIKTPTLDKLAAEGVKLENYYVQPICTPSRSQFITGKYQIHTGLQHSIIRPTQP
NCLPLDNATLPQKLKEVGYSTHMVGKWHLGFNRKECMPTRRGFDTFFGSLLGSGDYYTHYKCDSPGMCGYDLYEN
DNAAWDYDNGIYSTQMYTQRVQQILASHNPTKPIFLYTAYQAVHSPLQAPGRYFEHYRSIININRRRYAAMLSCL
DEAINNVTLALKTYGFYNNSIIIYSSDNGGQPTAGGSNWPLRGSKGTYWEGGIRAVGFVHSPLLKNKGTVCKELV
HITDWYPTLISLAEGQIDEDIQLDGYDIWETISEGLRSPRVDILHNIDPYTPRQKMAPGQQAMGSGTLQSSQPSE
CSTGNCLQEILATATGSPLSLSATWDRTGGTMNGSPCQLAKVYGFSTSQPTHMRGWTYLTGIQES

Important Features:
Signal Peptide:
amino acids 1-37

Sulfatases signature 1.
amino acids 120-132

Sulfatases signature 2.
amino acids 168-177

Tyrosine kinase phosphorylation site.
amino acids 163-169

N-glycosylation sites.
amino acids 157-160, 306-309 and 318-321

FIGURE 77

AAAAAAGCTCACTAAAGTTTCTATTAGAGCGAATACGGTAGATTTCCATCCCCTTTTGAAGAACAGTACTGTGGA
GCTATTTAAGAGATAAAAACGAAATATCCTTTCTGGGAGTTCAAGATTGTGCAGTAATTGGTTAGGACTCTGAGC
GCCGCTGTTCACCAATCGGGGAGAGAAAAGCGGAGATCCTGCTCGCCTTGCACGCGCCTGAAGCACAAAGCAGAT
AGCTAGGAATGAACCATCCCTGGGAGTATGTGGAAACAACGGAGGAGCTCTGACTTCCCAACTGTCCCATTCTAT
GGGCGAAGGAACTGCTCCTGACTTCAGTGGTTAAGGGCAGAATTGAAAATAATTCTGGAGGAAGATAAGAATGAT
TCCTGCGCGACTGCACCGGGACTACAAAGGGCTTGTCCTGCTGGGAATCCTCCTGGGGACTCTGTGGGAGACCGG
ATGCACCCAGATACGCTATTCAGTTCCGGAAGAGCTGGAGAAAGGCTCTAGGGTGGGCGACATCTCCAGGGACCT
GGGGCTGGAGCCCCGGGAGCTCGCGGAGCGCGGAGTCCGCATCATCCCCAGAGGTAGGACGCAGCTTTTCGCCCT
GAATCCGCGCAGCGGCAGCTTGGTCACGGCGGGCAGGATAGACCGGGAGGAGCTCTGTATGGGGGCCATCAAGTG
TCAATTAAATCTAGACATTCTGATGGAGGATAAAGTGAAAATATATGGAGTAGAAGTAGAAGTAAGGGACATTAA
CGACAATGCGCCTTACTTTCGTGAAAGTGAATTAGAAATAAAAATTAGTGAAAATGCAGCCACTGAGATGCGGTT
CCCTCTACCCCACGCCTGGGATCCGGATATCGGGAAGAACTCTCTGCAGAGCTACGAGCTCAGCCCGAACACTCA
CTTCTCCCTCATCGTGCAAAATGGAGCCGACGGTAGTAAGTACCCCGAATTGGTGCTGAAACGCGCCCTGGACCG
CGAAGAAAAGGCTGCTCACCACCTGGTCCTTACGGCCTCCGACGGGGGCGACCCGGTGCGCACAGGCACCGCGCG
CATCCGCGTGATGGTTCTGGATGCGAACGACAACGCACCAGCGTTTGCTCAGCCCGAGTACCGCGCGAGCGTTCC
GGAGAATCTGGCCTTGGGCACGCAGCTGCTTGTAGTCAACGCTACCGACCCTGACGAAGGAGTCAATGCGGAAGT
GAGGTATTCCTTCCGGTATGTGGACGACAAGGCGGCCCAAGTTTTCAAACTAGATTGTAATTCAGGGACAATATC
AACAATAGGGGAGTTGGACCACGAGGAGTCAGGATTCTACCAGATGGAAGTGCAAGCAATGGATAATGCAGGATA
TTCTGCGCGAGCCAAAGTCCTGATCACTGTTCTGGACGTGAACGACAATGCCCCAGAAGTGGTCCTCACCTCTCT
CGCCAGCTCGGTTCCCGAAAACTCTCCCAGAGGGACATTAATTGCCCTTTTAAATGTAAATGACCAAGATTCTGA
GGAAAACGGACAGGTGATCTGTTTCATCCAAGGAAATCTGCCCTTTAAATTAGAAAAATCTTACGGAAATTACTA
TAGTTTAGTCACAGACATAGTCTTGGATAGGGAACAGGTTCCTAGCTACAACATCACAGTGACCGCCACTGACCG
GGGAACCCCGCCCCTATCCACGGAAACTCATATCTCGCTGAACGTGGCAGACACCAACGACAACCCGCCGGTCTT
CCCTCAGGCCTCCTATTCCGCTTATATCCCAGAGAACAATCCCAGAGGAGTTTCCCTCGTCTCTGTGACCGCCCA
CGACCCCGACTGTGAAGAGAACGCCCAGATCACTTATTCCCTGGCTGAGAACACCATCCAAGGGGCAAGCCTATC
GTCCTACGTGTCCATCAACTCCGACACTGGGGTACTGTATGCGCTGAGCTCCTTCGACTACGAGCAGTTCCGAGA
CTTGCAAGTGAAAGTGATGGCGCGGGACAACGGGCACCCGCCCCTCAGCAGCAACGTGTCGTTGAGCCTGTTCGT
GCTGGACCAGAACGACAATGCGCCCGAGATCCTGTACCCCGCCCTCCCCACGGACGGTTCCACTGGCGTGGAGCT
GGCTCCCCGCTCCGCAGAGCCCGGCTACCTGGTGACCAAGGTGGTGGCGGTGGACAGAGACTCCGGCCAGAACGC
CTGGCTGTCCTACCGTCTGCTCAAGGCCAGCGAGCCGGGACTCTTCTCGGTGGGTCTGCACACGGGCGAGGTGCG
CACGGCGCGAGCCCTGCTGGACAGAGACGCGCTCAAGCAGAGCCTCGTAGTGGCCGTCCAGGACCACGGCCAGCC
CCCTCTCTCCGCCACTGTCACGCTCACCGTGGCCGTGGCCGACAGCATCCCCCAAGTCCTGGCGGACCTCGGCAG
CCTCGAGTCTCCAGCTAACTCTGAAACCTCAGACCTCACTCTGTACCTGGTGGTAGCGGTGGCCGCGGTCTCCTG
CGTCTTCCTGGCCTTCGTCATCTTGCTGCTGGCGCTCAGGCTGCGGCGCTGGCACAAGTCACGCCTGCTGCAGGC
TTCAGGAGGCGGCTTGACAGGAGCGCCGGCGTCGCACTTTGTGGGCGTGGACGGGGTGCAGGCTTTCCTGCAGAC
CTATTCCCACGAGGTTTCCCTCACCACGGACTCGCGGAAGAGTCACCTGATCTTCCCCCAGCCCAACTATGCAGA
CATGCTCGTCAGCCAGGAGAGCTTTGAAAAAAGCGAGCCCCTTTTGCTGTCAGGTGATTCGGTATTTTCTAAAGA
CAGTCATGGGTTAATTGAGGTGAGTTTATATCAAATCTTCTTTCTTTTTTTTTTTAATTGCTCTGTCTCCCAAGC
TGGAGTGCAGCGGTACGATCATAGCTCACTGCGGCCTCAAACTCCTAGGCTCAAGCAATTATCCCACCTTTGCCT
CCGGTGTAACAGGGACTACAGGTGCAAGCCACCTACTGTCTGCCTATCTATCTATCTATCTATCTATCTATCTAT
CTATCTATCTATCTATCTATTACTTTCTTGTACAGACGGGAGTCTCACGCCTGTAATCCCAGTACTTTGGGAGGC
CGAGGCGGGTGGATCACCTGAGGTTGGGAGTTTGAGACCAGCCTGACCAACATGGAGAAACCCCGTCTATACTAA
AAAAATACAAAATTAGCCGGGCGTGGTGGTGCATGTCTGTAATCCCAGCTACTTGGGAGGCTGAGTCAGGAGAAT
TGCTTTAACCTGGGAGGTGGAGGTTGCAATGAGCTGAGATTGTGCCATTGCACTCCAGCCTGGGCAACAAGAGTG
AAACTCTATCTCA

FIGURE 78

></usr/seqdb2/sst/DNA/Dnaseqs.min/ss.DNA48306
><subunit 1 of 1, 916 aa, 1 stop
><MW: 100204, pI: 4.92, NX(S/T): 4
MIPARLHRDYKGLVLLGILLGTLWETGCTQIRYSVPEELEKGSRVGDISRDLGLEPRELAERGVRIIPRGRTQLF
ALNPRSGSLVTAGRIDREELCMGAIKCQLNLDILMEDKVKIYGVEVEVRDINDNAPYFRESELEIKISENAATEM
RFPLPHAWDPDIGKNSLQSYELSPNTHFSLIVQNGADGSKYPELVLKRALDREEKAAHHLVLTASDGGDPVRTGT
ARIRVMVLDANDNAPAFAQPEYRASVPENLALGTQLLVVNATDPDEGVNAEVRYSFRYVDDKAAQVFKLDCNSGT
ISTIGELDHEESGFYQMEVQAMDNAGYSARAKVLITVLDVNDNAPEVVLTSLASSVPENSPRGTLIALLNVNDQD
SEENGQVICFIQGNLPFKLEKSYGNYYSLVTDIVLDREQVPSYNITVTATDRGTPPLSTETHISLNVADTNDNPP
VFPQASYSAYIPENNPRGVSLVSVTAHDPDCEENAQITYSLAENTIQGASLSSYVSINSDTGVLYALSSFDYEQF
RDLQVKVMARDNGHPPLSSNVSLSLFVLDQNDNAPEILYPALPTDGSTGVELAPRSAEPGYLVTKVVAVDRDSGQ
NAWLSYRLLKASEPGLFSVGLHTGEVRTARALLDRDALKQSLVVAVQDHGQPPLSATVTLTVAVADSIPQVLADL
GSLESPANSETSDLTLYLVVAVAAVSCVFLAFVILLLALRLRRWHKSRLLQASGGGLTGAPASHFVGVDGVQAFL
QTYSHEVSLTTDSRKSHLIFPQPNYADMLVSQESFEKSEPLLLSGDSVFSKDSHGLIEVSLYQIFFLFFFNCSVS
QAGVQRYDHSSLRPQTPRLKQLSHLCLRCNRDYRCKPPTVCLSIYLSIYLSIYLSIYLLLSCTDGSLTPVIPVLW
EAEAGGSPEVGSLRPA

Signal sequence:
amino acids 1-30

Transmembrane domains:
amino acids 693-711, 809-823, 869-888

FIGURE 79

AGCCGCTGCCCCGGGCCGGGCGCCCGCGGCGGCACCATGAGTCCCCGCTCGTGCCTGCGTTCGCTGCGCCTCCTC
GTCTTCGCCGTCTTCTCAGCCGCCGCGAGCAACTGGCTGTACCTGGCCAAGCTGTCGTCGGTGGGGAGCATCTCA
GAGGAGGAGACGTGCGAGAAACTCAAGGGCCTGATCCAGAGGCAGGTGCAGATGTGCAAGCGGAACCTGGAAGTC
ATGGACTCGGTGCGCCGCGGTGCCCAGCTGGCCATTGAGGAGTGCCAGTACCAGTTCCGGAACCGGCGCTGGAAC
TGCTCCACACTCGACTCCTTGCCCGTCTTCGGCAAGGTGGTGACGCAAGGGACTCGGGAGGCGGCCTTCGTGTAC
GCCATCTCTTCGGCAGGTGTGGCCTTTGCAGTGACGCGGGCGTGCAGCAGTGGGGAGCTGGAGAAGTGCGGCTGT
GACAGGACAGTGCATGGGGTCAGCCCACAGGGCTTCCAGTGGTCAGGATGCTCTGACAACATCGCCTACGGTGTG
GCCTTCTCACAGTCGTTTGTGGATGTGCGGGAGAGAAGCAAGGGGGCCTCGTCCAGCAGAGCCCTCATGAACCTC
CACAACAATGAGGCCGGCAGGAAGGCCATCCTGACACACATGCGGGTGGAATGCAAGTGCCACGGGGTGTCAGGC
TCCTGTGAGGTAAAGACGTGCTGGCGAGCCGTGCCGCCCTTCCGCCAGGTGGGTCACGCACTGAAGGAGAAGTTT
GATGGTGCCACTGAGGTGGAGCCACGCCGCGTGGGCTCCTCCAGGGCACTGGTACCACGCAACGCACAGTTCAAG
CCGCACACAGATGAGGACCTGGTGTACTTGGAGCCTAGCCCCGACTTCTGTGAGCAGGACATGCGCAGCGGCGTG
CTGGGCACGAGGGGCCGCACATGCAACAAGACGTCCAAGGCCATCGACGGCTGTGAGCTGCTGTGCTGTGGCCGC
GGCTTCCACACGGCGCAGGTGGAGCTGGCTGAACGCTGCAGCTGCAAATTCCACTGGTGCTGCTTCGTCAAGTGC
CGGCAGTGCCAGCGGCTCGTGGAGTTGCACACGTGCCGATGACCGCCTGCCTAGCCCTGCGCCGGCAACCACCTA
GTGGCCCAGGGAAGGCCGATAATTTAAACAGTCTCCCACCACCTACCCCAAGAGATACTGGTTGTATTTTTTGTT
CTGGTTTGGTTTTTGGGTCCTCATGTTATTTATTGCCGAAACCAGGCAGGCAACCCCAAGGGCACCAACCAGGGC
CTCCCCAAAGCCTGGGCCTTTGTGGCTGCCACTGACCAAAGGGACCTTGCTCGTGCCGCTGGCTGCCCGCATGTG
GCTGCCACTGACCACTCAGTTGTTATCTGTGTCCGTTTTTCTACTTGCAGACCTAAGGTGGAGTAACAAGGAGTA
TTACCACCACATGGCTACTGACCGTGTCATCGGGGAAGAGGGGGCCTTATGGCAGGGAAAATAGGTACCGACTTG
ATGGAAGTCACACCCTCTGGAAAAAAGAACTCTTAACTCTCCAGCACACATACACATGGACTCCTGGCAGCTTGA
GCCTAGAAGCCATGTCTCTCAAATGCCCTGAGAAAGGGAACAAGCAGATACCAGGTCAAGGGCACCAGGTTCATT
TCAGCCCTTACATGGACAGCTAGAGGTTCGATATCTGTGGGTCCTTCCAGGCAAGAAGAGGGAGATGAGAGCAAG
AGACGACTGAAGTCCCACCCTAGAACCCAGCCTGCCCCAGCCTGCCCCTGGGAAGAGGAAACTTAACCACTCCCC
AGACCCACCTAGGCAGGCATATAGGCTGCCATCCTGGACCAGGGATCCCGGCTGTGCCTTTGCAGTCATGCCCGA
GTCACCTTTCACAGCGCTGTTCCTCCATGAAACTGAAAAACACACACACACACACACACACACACACACACACAC
ACACACACACGGACACACACACACACCTGCGAGAGAGAGGGAGGAAAGGCTGTGCCTTTGCAGTCATGCCCGAG
TCACCTTTCACAGCACTGTTCCTC

FIGURE 80

</usr/seqdb2/sst/DNA/Dnaseqs.min/ss.DNA48328
<subunit 1 of 1, 351 aa, 1 stop
<MW: 39052, pI: 8.97, NX(S/T): 2
MSPRSCLRSLRLLVFAVFSAAASNWLYLAKLSSVGSISEEETCEKLKGLIQRQVQMCKRNLEVMDSVRRGAQLAI
EECQYQFRNRRWNCSTLDSLPVFGKVVTQGTREAAFVYAISSAGVAFAVTRACSSGELEKCGCDRTVHGVSPQGF
QWSGCSDNIAYGVAFSQSFVDVRERSKGASSSRALMNLHNNEAGRKAILTHMRVECKCHGVSGSCEVKTCWRAVP
PFRQVGHALKEKFDGATEVEPRRVGSSRALVPRNAQFKPHTDEDLVYLEPSPDFCEQDMRSGVLGTRGRTCNKTS
KAIDGCELLCCGRGFHTAQVELAERCSCKFHWCCFVKCRQCQRLVELHTCR

Important features:
Signal peptide:
amino acids 1-22

N-glycosylation sites.
amino acids 88-91 and 297-300

Wnt-1 family signature.
amino acids 206-215

Homologous region to Wnt-1 family proteins
amino acids 183-235, 305-350, 97-138, 53-92 and 150 -174

FIGURE 81

CCGAGCCGGGCGCGCAGCGACGGAGCTGGGGCCGGCCTGGGACCATGGGCGTGAGTGCAATCTACGGATCAGTCT
CTGATGGTGGGTCGTTAACCTCAGTGGGGACTCCAAGATTTCCATGAAGAAAATCAGTTGTCTTCATTCAAGAAT
TGGGGTCTGGCTCAGAATTCCTGCAGCTGGTGAAAATCTGTTTTCTAGAAGAGGTTTAATTAATGCCTGCAGTCT
GACATGTTCCCGATTTGAGGTGAAACCATGAAGAGAAAATAGAATACTTAATA<u>ATG</u>CTTTTCCGCAACCGCTTCT
TGCTGCTGCTGGCCCTGGCTGCGCTGCTGGCCTTTGTGAGCCTCAGCCTGCAGTTCTTCCACCTGATCCCGGTGT
CGACTCCTAAGAATGGAATGAGTAGCAAGAGTCGAAAGAGAATCATGCCCGACCCTGTGACGGAGCCCCCTGTGA
CAGACCCCGTTTATGAAGCTCTTTTGTACTGCAACATCCCCAGTGTGGCCGAGCGCAGCATGGAAGGTCATGCCC
CGCATCATTTTAAGCTGGTCTCAGTGCATGTGTTCATTCGCCACGGAGACAGGTACCCACTGTATGTCATTCCCA
AAACAAAGCGACCAGAAATTGACTGCACTCTGGTGGCTAACAGGAAACCGTATCACCCAAAACTGGAAGCTTTCA
TTAGTCACATGTCAAAAGGATCCGGAGCCTCTTTCGAAAGCCCCTTGAACTCCTTGCCTCTTTACCCAAATCACC
CATTGTGTGAGATGGGAGAGCTCACACAGACAGGAGTTGTGCAGCATTTGCAGAACGGTCAGCTGCTGAGGGATA
TCTATCTAAAGAAACACAAACTCCTGCCCAATGATTGGTCTGCAGACCAGCTCTATTTAGAGACCACTGGGAAAA
GCCGGACCCTACAAAGTGGGCTGGCCTTGCTTTATGGCTTTCTCCCAGATTTTGACTGGAAGAAGATTTATTTCA
GGCACCAGCCAAGTGCGCTGTTCTGCTCTGGAAGCTGCTATTGCCCGGTAAGAAACCAGTATCTGGAAAAGGAGC
AGCGTCGTCAGTACCTCCTACGTTTGAAAAACAGCCAGCTGGAGAAGACCTACGGGGAGATGGCCAAGATCGTGG
ATGTCCCCACCAAGCAGCTTAGAGCTGCCAACCCCATAGACTCCATGCTCTGCCACTTCTGCCACAATGTCAGCT
TTCCCTGTACCAGAAATGGCTGTGTTGACATGGAGCACTTCAAGGTAATTAAGACCCATCAGATCGAGGATGAAA
GGGAAAGACGGGAGAAGAAATTGTACTTCGGGTATTCTCTCCTGGGTGCCCACCCCATCCTGAACCAAACCATCG
GCCGGATGCAGCGTGCCACCGAGGGCAGGAAAGAAGAGCTCTTTGCCCTCTACTCTGCTCATGATGTCACTCTGT
CACCAGTTCTCAGTGCCTTGGGCCTTTCAGAAGCCAGGTTCCCAAGGTTTGCAGCCAGGTTGATCTTTGAGCTTT
GGCAAGACAGAGAAAAGCCCAGTGAACATTCCGTCCGGATTCTTTACAATGGCGTCGATGTCACATTCCACACCT
CTTTCTGCCAAGACCACCACAAGCGTTCTCCCAAGCCCATGTGCCCGCTTGAAAACTTGGTCCGCTTTGTGAAAA
GGGACATGTTTGTAGCCCTGGGTGGCAGTGGTACAAATTATTATGATGCATGTCACAGGGAAGGATTC<u>TAA</u>AAGG
TATGCAGTACAGCAGTATAGAATCCATGCCAATACAGAGCATAGGGAAAGGTCCACTTCTAGTTTTGTCTGTTAC
TAAGGGTAGAAGATTATTGCTTTTTAAAGGCTAAATATTGTTTGTGGGAACCACAGATGGTTGGGGTTGAACAGT
AAGCACATTGCTGCAATGTGGTACGTGAATTGCTTGGTACAAAATGGCCAGTTCACAGAGGAATAGAAGGTACTT
TATCATAGCCAGACTTCGCTTAGAATGCCAGAATAATATAGTTCAAGACCTGAAGTTGCCAATCCAAGTTTGCAC
TCTTCTGGCCTGCCCCATGTTACTATGTGATGGAACCAGCACACCTCAACCAAAATTTTTTTAATCTTAGACATT
TTTACCTTGTCCTTGTTAAGAATTTCTTGAAGTGATTTATCTAAAATAAAGGTTGGCAAACTTTTTCTGTAAAGG
GCCAGATTGTAAATATTTCAGACTGTGTGGACCAAAAGGCCACATACAGTCTCTGTCATAACTACTCAACTCTGT
TTCTGAAGCAGGAAAGCCACCACAGACAGTACATAAAGGAATATGTGTAGCTGGGTTCCCAGGCCAGACAAAACA
GATGGTGACCAGACTTGGCCCCTGGGCTGTAGTTTGCTGACCCCTCATCTAAAAAATAGGCTATACTACAATTGC
ACTTCCAGCACTTTGAGAACGAGTTGAATACCAAGAATTATTCAATGGTTCCTCCAGTAACTTCTGCTAGAAACA
CAGAATTTGGTCTGTATCTGACACTAGAACAAAACTTGAGGGTAAATAAACATTGAATTAGAATGAATCATAGAA
AACTGATTAGAAGAATACTTGATGTTTATGATGATTGTGGTACAAGATAGTTTTAAGTATGTTCTAAATATTTGT
CTGCTGTAGTCTATTTGCTGTATATGCTGAAATTTTTGTATGCCATTTAGTATTTTTATAGTTTAGGAAAATATT
TTCTAAGACCAGTTTTAGATGACTCTTATTCCTGTAGTAATATTCAATTTGCTGTACCTGCTTGGTGGTTAGAAG
GAGGCTAGAAGATGAATTCAGGCACTTTCTTCCAATAAAACTAATTATGGCTCATTCCCTTTGACAAGCTGTAGA
ACTGGATTCATTTTTAAACCATTTTCATCAGTTTCAAATGGTAAATTCTGATTGATTTTTAAATGCGTTTTTGGA
AGAACTTTGCTATTAGGTAGTTTACAGATCTTTATAAGGTGTTTTATATATTAGAAGCAATTATAATTACATCTG
TGATTTCTGAACTAATGGTGCTAATTCAGAGAAATGGAAAGTGAAAGTGAGATTCTCTGTTGTCATCGGCATTCC
AACTTTTTCTCTTTGTTTTTGTCCAGTGTTGCATTTGAATATGTCTGTTTCTATAAATAAATTTTTTAAGAATAA

FIGURE 82

></usr/seqdb2/sst/DNA/Dnaseqs.min/ss.DNA48329
><subunit 1 of 1, 480 aa, 1 stop
><MW: 55240, pI: 9.30, NX(S/T): 2
MLFRNRFLLLLALAALLAFVSLSLQFFHLIPVSTPKNGMSSKSRKRIMPDPVTEPPVTDPVYEALLYCNIPSVAE
RSMEGHAPHHFKLVSVHVFIRHGDRYPLYVIPKTKRPEIDCTLVANRKPYHPKLEAFISHMSKGSGASFESPLNS
LPLYPNHPLCEMGELTQTGVVQHLQNGQLLRDIYLKKHKLLPNDWSADQLYLETTGKSRTLQSGLALLYGFLPDF
DWKKIYFRHQPSALFCSGSCYCPVRNQYLEKEQRRQYLLRLKNSQLEKTYGEMAKIVDVPTKQLRAANPIDSMLC
HFCHNVSFPCTRNGCVDMEHFKVIKTHQIEDERERREKKLYFGYSLLGAHPILNQTIGRMQRATEGRKEELFALY
SAHDVTLSPVLSALGLSEARFPRFAARLIFELWQDREKPSEHSVRILYNGVDVTFHTSFCQDHHKRSPKPMCPLE
NLVRFVKRDMFVALGGSGTNYYDACHREGF

Signal sequence:
amino acids 1-18

FIGURE 83

TCTCGCAGATAGTAAATAATCTCGGAAAGGCGAGAAAGAAGCTGTCTCCATCTTGTCTGTATCCGCTGCTCTTGT
GACGTTGTGGAGATGGGGAGCGTCCTGGGGCTGTGCTCCATGGCGAGCTGGATACCATGTTTGTGTGGAAGTGCC
CCGTGTTTGCTATGCCGATGCTGTCCTAGTGGAAACAACTCCACTGTAACTAGATTGATCTATGCACTTTTCTTG
CTTGTTGGAGTATGTGTAGCTTGTGTAATGTTGATACCAGGAATGGAAGAACAACTGAATAAGATTCCTGGATTT
TGTGAGAATGAGAAAGGTGTTGTCCCTTGTAACATTTTGGTTGGCTATAAAGCTGTATATCGTTTGTGCTTTGGT
TTGGCTATGTTCTATCTTCTTCTCTCTTTACTAATGATCAAAGTGAAGAGTAGCAGTGATCCTAGAGCTGCAGTG
CACAATGGATTTTGGTTCTTTAAATTTGCTGCAGCAATTGCAATTATTATTGGGGCATTCTTCATTCCAGAAGGA
ACTTTTACAACTGTGTGGTTTTATGTAGGCATGGCAGGTGCCTTTTGTTTCATCCTCATACAACTAGTCTTACTT
ATTGATTTTGCACATTCATGGAATGAATCGTGGGTTGAAAAAATGGAAGAAGGGAACTCGAGATGTTGGTATGCA
GCCTTGTTATCAGCTACAGCTCTGAATTATCTGCTGTCTTTAGTTGCTATCGTCCTGTTCTTTGTCTACTACACT
CATCCAGCCAGTTGTTCAGAAAACAAGGCGTTCATCAGTGTCAACATGCTCCTCTGCGTTGGTGCTTCTGTAATG
TCTATACTGCCAAAAATCCAAGAATCACAACCAAGATCTGGTTTGTTACAGTCTTCAGTAATTACAGTCTACACA
ATGTATTTGACATGGTCAGCTATGACCAATGAACCAGAAACAAATTGCAACCCAAGTCTACTAAGCATAATTGGC
TACAATACAACAAGCACTGTCCCAAAGGAAGGGCAGTCAGTCCAGTGGTGGCATGCTCAAGGAATTATAGGACTA
ATTCTCTTTTTGTTGTGTGTATTTTATTCCAGCATCCGTACTTCAAACAATAGTCAGGTTAATAAACTGACTCTA
ACAAGTGATGAATCTACATTAATAGAAGATGGTGGAGCTAGAAGTGATGGATCACTGGAGGATGGGGACGATGTT
CACCGAGCTGTAGATAATGAAAGGGATGGTGTCACTTACAGTTATTCCTTCTTTCACTTCATGCTTTTCCTGGCT
TCACTTTATATCATGATGACCCTTACCAACTGGTCCAGGTATGAACCCTCTCGTGAGATGAAAAGTCAGTGGACA
GCTGTCTGGGTGAAAATCTCTTCCAGTTGGATTGGCATCGTGCTGTATGTTTGGACACTCGTGGCACCACTTGTT
CTTACAAATCGTGATTTTGACTGAGTGAGACTTCTAGCATGAAAGTCCCACTTTGATTATTGCTTATTTGAAAAC
AGTATTCCCAACTTTTGTAAAGTTGTGTATGTTTTTGCTTCCCATGTAACTTCTCCAGTGTTCTGGCATGAATTA
GATTTTACTGCTTGTCATTTTGTTATTTTCTTACCAAGTGCATTGATATGTGAAGTAGAATGAATTGCAGAGGAA
AGTTTTATGAATATGGTGATGAGTTAGTAAAAGTGGCCATTATTGGGCTTATTCTCTGCTCTATAGTTGTGAAAT
GAAGAGTAAAAACAAATTTGTTTGACTATTTTAAAATTATATTAGACCTTAAGCTGTTTTAGCAAGCATTAAAGC
AAATGTATGGCTGCCTTTTGAAATATTTGATGTGTTGCCTGGCAGGATACTGCAAAGAACATGGTTTATTTTAAA
ATTTATAAACAAGTCACTTAAATGCCAGTTGTCTGAAAAATCTTATAAGGTTTTACCCTTGATACGGAATTTACA
CAGGTAGGGAGTGTTTAGTGGACAATAGTGTAGGTTATGGATGGAGGTGTCGGTACTAAATTGAATAACGAGTAA
ATAATCTTACTTGGGTAGAGATGGCCTTTGCCAACAAAGTGAACTGTTTTGGTTGTTTTAAACTCATGAAGTATG
GGTTCAGTGGAAATGTTTGGAACTCTGAAGGATTTAGACAAGGTTTTGAAAAGGATAATCATGGGTTAGAAGGAA
GTGTTTTGAAAGTCACTTTGAAAGTTAGTTTTGGGCCCAGCACGGTAGCTCACCCTTGGTAATCCCAGCACTTTG
GGAGCTTAAGTGGGTAGATTACTTGAGCCCAGGAATTCAGACCAGCTTGGCACATGGTGAACCTGTTCTATAAAA
ATAATCTGGCTTTGAGCATATGCCTGTGGTCCAGCACTGAGAGGCTAGTGAAGATTGCTGAGCCCAGAGCCAAAG
GTTGCAGTGAGCAAGTCACGTCACTGCACTCTAGCTGGCACAGAGTAAGCCAAAAAAATATATATATATTGAAAT
CAAGGAGGCAAAATTTTGACAGGGAAGGAAGTAACTGCAAAACCACTAGGCTTTAGTAGGTACTTATATAAAATC
TAGTCCAGTTCTCTCATTTAAAAAAATGAAGACACTGAAATACAGACTTAAATAGCTCAGATAGCTAATTAGGAA
ATTTCAAGTTGGCCAATAATAGCATTCTCTCTGACATTTAAAAATAATTTCTATTCAAAATACATGCATATTGAT
TTACACCTCATACTGTGATAATTAATGTGATGTGGATTGCTGGTGTCCAGCATGACCCATAAACAGGTCAGAAGA
ATGATGGAATGTTTTAGAATAAACTCCTGCTTATAGTATACTACACAGTTCAAAAGATGTTTAAAATGCTTTTGT
ATTTACTGCCATGTAATTGAAATATATAGATTATTGTAACCTTTCAACCTGAAAATCAAGCAGTATGAGAGTTTA
GTTATTTGTATGTGTCACTAGTGTCTAATGAAGCTTTTAAAATCTACAATTTCTTCTTTAAAAATATTTATTAAT
GTGAATGGAATATAACAATTCAGCTTAATTCCCCAACCTTATTCTGTGTGTAGACATTGTATTCCACAATTTTGA
ATGGCTGTGTTTTACCTCTAAATAAATGAATTCAGAGAAAAAAAAAAAAAAA

FIGURE 84

MGSVLGLCSMASWIPCLCGSAPCLLCRCCPSGNNSTVTRLIYALFLLVGVCVACVMLIPGMEEQLNKIPGFCENE
KGVVPCNILVGYKAVYRLCFGLAMFYLLLSLLMIKVKSSSDPRAAVHNGFWFFKFAAAIAIIIGAFFIPEGTFTT
VWFYVGMAGAFCFILIQLVLLIDFAHSWNESWVEKMEEGNSRCWYAALLSATALNYLLSLVAIVLFFVYYTHPAS
CSENKAFISVNMLLCVGASVMSILPKIQESQPRSGLLQSSVITVYTMYLTWSAMTNEPETNCNPSLLSIIGYNTT
STVPKEGQSVQWWHAQGIIGLILFLLCVFYSSIRTSNNSQVNKLTLTSDESTLIEDGGARSDGSLEDGDDVHRAV
DNERDGVTYSYSFFHFMLFLASLYIMMTLTNWSRYEPSREMKSQWTAVWVKISSSWIGIVLYVWTLVAPLVLTNRDFD

FIGURE 85

AACAAAGTTCAGTGACTGAGAGGGCTGAGCGGAGGCTGCTGAAGGGGAGAAAGGAGTGAGGAGCTGCTGGGCAGA
GAGGGACTGTCCGGCTCCCAGATGCTGGGCCTCCTGGGGAGCACAGCCCTCGTGGGATGGATCACAGGTGCTGCT
GTGGCGGTCCTGCTGCTGCTGCTGCTGCTGGCCACCTGCCTTTTCCACGGACGGCAGGACTGTGACGTGGAGAGG
AACCGTACAGCTGCAGGGGGAAACCGAGTCCGCCGGGCCCAGCCTTGGCCCTTCCGGCGGCGGGGCCACCTGGGA
ATCTTTCACCATCACCGTCATCCTGGCCACGTATCTCATGTGCCGAATGTGGGCCTCCACCACCACCACCACCCC
CGCCACACCCCTCACCACCTCCACCACCACCACCACCCCCACCGCCACCATCCCCGCCACGCTCGCTGAGGCTGC
TGTCGCCGGTGCCTGTGGACAGCAGCTGCCCCTGCCCTCCCATCTGTTCCCAGGACAAGTGGACCCCATGTTTCC
ATGTGGAAGGATGCATCTCTGGGGTGAACGAGGGGAACAATAGACTGGGGCTTGCTCCAGCTGCATTTGCATGGC
ATGCCCCAGTGTACTATGGCAGCAGAGAATGGAGGAACACTGGGTCTGCAGTGCTGAAGGGTTTGGGGAGTGGAG
AGCAAGGGTGCTCTTTCGGGGCTGGACAGCCCGTCTTGTGACAGTGACTCCCAGTGAGCCCCAGAAATGACAAGC
GTGTCTTGGCAGAGCCAGCACACAAGTGGATGTGAAGTGCCCGTCTTGACCTCCTCATCAGGCTGCTGCAGGCCT
CTGGCGGGCAGGGCACTGGGAGAGGCCCTGAGAATGTCCTTTTGGTTTGGAGAAGGCAGTGTGAGGCTGCACAGT
CAATTCATCGGTGCCTTAGTCCAAGAAAATAAAAACCACTAAGAAGCTTTAAAAAAAAAAAAAAA

FIGURE 86

MLGLLGSTALVGWITGAAVAVLLLLLLLATCLFHGRQDCDVERNRTAAGGNRVRRAQPWPFRRRGHLGIFHHHRH
PGHVSHVPNVGLHHHHHPRHTPHHLHHHHHPHRHHPRHAR

FIGURE 87

CCCACGCGTCCGTCCTAGTCCCCGGGCCAACTCGGACAGTTTGCTCATTTATTGCAACGGTCAAGGCTGGCTTGT
GCCAGAACGGCGCGCGCGCGCGCACGCACGCACACACACGGGGGGAAACTTTTTTAAAAATGAAAGGCTAGAAGA
GCTCAGCGGCGGCGCGGGCGCTGCGCGAGGGCTCCGGAGCTGACTCGCCGAGGCAGGAAATCCCTCCGGTCGCGA
CGCCCGGCCCCGGCTCGGCGCCCGCGTGGGATGGTGCAGCGCTCGCCGCCGGGCCCGAGAGCTGCTGCACTGAAG
GCCGGCGACGATGGCAGCGCGCCCGCTGCCCGTGTCCCCCGCCCGCGCCCTCCTGCTCGCCCTGGCCGGTGCTCT
GCTCGCGCCCTGCGAGGCCCGAGGGGTGAGCTTATGGAACCAAGGAAGAGCTGATGAAGTTGTCAGTGCCTCTGT
TCGGAGTGGGGACCTCTGGATCCCAGTGAAGAGCTTCGACTCCAAGAATCATCCAGAAGTGCTGAATATTCGACT
ACAACGGGAAAGCAAAGAACTGATCATAAATCTGGAAAGAAATGAAGGTCTCATTGCCAGCAGTTTCACGGAAAC
CCACTATCTGCAAGACGGTACTGATGTCTCCCTCGCTCGAAATTACACGGGTCACTGTTACTACCATGGACATGT
ACGGGGATATTCTGATTCAGCAGTCAGTCTCAGCACGTGTTCTGGTCTCAGGGGACTTATTGTGTTTGAAAATGA
AAGCTATGTCTTAGAACCAATGAAAAGTGCAACCAACAGATACAAACTCTTCCCAGCGAAGAAGCTGAAAAGCGT
CCGGGGATCATGTGGATCACATCACAACACACCAAACCTCGCTGCAAAGAATGTGTTTCCACCACCCTCTCAGAC
ATGGGCAAGAAGGCATAAAAGAGAGACCCTCAAGGCAACTAAGTATGTGGAGCTGGTGATCGTGGCAGACAACCG
AGAGTTTCAGAGGCAAGGAAAAAGATCTGGAAAAAGTTAAGCAGCGATTAATAGAGATTGCTAATCACGTTGACAA
GTTTTACAGACCACTGAACATTCGGATCGTGTTGGTAGGCGTGGAAGTGTGGAATGACATGGACAAATGCTCTGT
AAGTCAGGACCCATTCACCAGCCTCCATGAATTTCTGGACTGGAGGAAGATGAAGCTTCTACCTCGCAAATCCCA
TGACAATGCGCAGCTTGTCAGTGGGGTTTATTTCCAAGGGACCACCATCGGCATGGCCCCAATCATGAGCATGTG
CACGGCAGACCAGTCTGGGGGAATTGTCATGGACCATTCAGACAATCCCCTTGGTGCAGCCGTGACCCTGGCACA
TGAGCTGGGCCACAATTTCGGGATGAATCATGACACACTGGACAGGGGCTGTAGCTGTCAAATGGCGGTTGAGAA
AGGAGGCTGCATCATGAACGCTTCCACCGGGTACCCATTTCCCATGGTGTTCAGCAGTTGCAGCAGGAAGGACTT
GGAGACCAGCCTGGAGAAAGGAATGGGGGTGTGCCTGTTTAACCTGCCGGAAGTCAGGGAGTCTTTCGGGGGCCA
GAAGTGTGGGAACAGATTTGTGGAAGAAGGAGAGGAGTGTGACTGTGGGGAGCCAGAGGAATGTATGAATCGCTG
CTGCAATGCCACCACCTGTACCCTGAAGCCGGACGCTGTGTGCGCACATGGGCTGTGCTGTGAAGACTGCCAGCT
GAAGCCTGCAGGAACAGCGTGCAGGGACTCCAGCAACTCCTGTGACCTCCCAGAGTTCTGCACAGGGGCCAGCCC
TCACTGCCCAGCCAATGTGTACCTGCACGATGGGCACTCATGTCAGGATGTGGACGGCTACTGCTACAATGGCAT
CTGCCAGACTCACGAGCAGCAGTGTGTCACGCTCTGGGGACCAGGTGCTAAACCTGCCCCTGGGATCTGCTTTGA
GAGAGTCAATTCTGCAGGTGATCCTTATGGCAACTGTGGCAAAGTCTCGAAGAGTTCCTTTGCCAAATGCGAGAT
GAGAGATGCTAAATGTGGAAAAATCCAGTGTCAAGGAGGTGCCAGCCGGCCAGTCATTGGTACCAATGCCGTTTC
CATAGAAACAAACATCCCTCTGCAGCAAGGAGGCCGGATTCTGTGCCGGGGGACCCACGTGTACTTGGGCGATGA
CATGCCGGACCCAGGGCTTGTGCTTGCAGGCACAAAGTGTGCAGATGGAAAAATCTGCCTGAATCGTCAATGTCA
AAATATTAGTGTCTTTGGGGTTCACGAGTGTGCAATGCAGTGCCACGGCAGAGGGGTGTGCAACAACAGGAAGAA
CTGCCACTGCGAGGCCCACTGGGCACCTCCCTTCTGTGACAAGTTTGGCTTTGGAGGAAGCACAGACAGCGGCCC
CATCCGGCAAGCAGAAGCAAGGCAGGAAGCTGCAGAGTCCAACAGGGAGCGCGGCCAGGGCCAGGAGCCCGTGGG
ATCGCAGGAGCATGCGTCTACTGCCTCACTGACACTCATCTGAGCCCTCCCATGACATGGAGACCGTGACCAGTG
CTGCTGCAGAGGAGGTCACGCGTCCCCAAGGCCTCCTGTGACTGGCAGCATTGACTCTGTGGCTTTGCCATCGTT
TCCATGACAACAGACACAACACAGTTCTCGGGGCTCAGGAGGGGAAGTCCAGCCTACCAGGCACGTCTGCAGAAA
CAGTGCAAGGAAGGGCAGCGACTTCCTGGTTGAGCTTCTGCTAAAACATGGACATGCTTCAGTGCTGCTCCTGAG
AGAGTAGCAGGTTACCACTCTGGCAGGCCCCAGCCCTGCAGCAAGGAGGAAGAGGACTCAAAAGTCTGGCCTTTC
ACTGAGCCTCCACAGCAGTGGGGGAGAAGCAAGGGTTGGGCCCAGTGTCCCCTTTCCCCAGTGACACCTCAGCCT
TGGCAGCCCTGATGACTGGTCTCTGGCTGCAACTTAATGCTCTGATATGGCTTTTAGCATTTATTATATGAAAAT
AGCAGGGTTTTAGTTTTTAATTTATCAGAGACCCTGCCACCCATTCCATCTCCATCCAAGCAAACTGAATGGCAA
TGAAACAAACTGGAGAAGAAGGTAGGAGAAAGGGCGGTGAACTCTGGCTCTTTGCTGTGGACATGCGTGACCAGC
AGTACTCAGGTTTGAGGGTTTGCAGAAAGCCAGGGAACCCACAGAGTCACCAACCCTTCATTTAACAAGTAAGAA
TGTTAAAAAGTGAAAACAATGTAAGAGCCTAACTCCATCCCCCGTGGCCATTACTGCATAAAATAGAGTGCATTT
GAAAT

FIGURE 88

></usr/seqdb2/sst/DNA/Dnaseqs.min/ss.DNA49624
><subunit 1 of 1, 735 aa, 1 stop
><MW: 80177, pI: 7.08, NX(S/T): 5
MAARPLPVSPARALLLALAGALLAPCEARGVSLWNQGRADEVVSASVRSGDLWIPVKSFDSKNHPEVLNIRLQRE
SKELIINLERNEGLIASSFTETHYLQDGTDVSLARNYTGHCYYHGHVRGYSDSAVSLSTCSGLRGLIVFENESYV
LEPMKSATNRYKLFPAKKLKSVRGSCGSHHNTPNLAAKNVFPPPSQTWARRHKRETLKATKYVELVIVADNREFQ
RQGKDLEKVKQRLIEIANHVDKFYRPLNIRIVLVGVEVWNDMDKCSVSQDPFTSLHEFLDWRKMKLLPRKSHDNA
QLVSGVYFQGTTIGMAPIMSMCTADQSGGIVMDHSDNPLGAAVTLAHELGHNFGMNHDTLDRGCSCQMAVEKGGC
IMNASTGYPFPMVFSSCSRKDLETSLEKGMGVCLFNLPEVRESFGGQKCGNRFVEEGEECDCGEPEECMNRCCNA
TTCTLKPDAVCAHGLCCEDCQLKPAGTACRDSSNSCDLPEFCTGASPHCPANVYLHDGHSCQDVDGYCYNGICQT
HEQQCVTLWGPGAKPAPGICFERVNSAGDPYGNCGKVSKSSFAKCEMRDAKCGKIQCQGGASRPVIGTNAVSIET
NIPLQQGGRILCRGTHVYLGDDMPDPGLVLAGTKCADGKICLNRQCQNISVFGVHECAMQCHGRGVCNNRKNCHC
EAHWAPPFCDKFGFGGSTDSGPIRQAEARQEAAESNRERGQGQEPVGSQEHASTASLTLI

Signal peptide:
amino acids 1-28

FIGURE 89

CTGCTGCATCCGGGTGTCTGGAGGCTGTGGCCGTTTTGTTTTCTTGGCTAAAATCGGGGGAGTGAGGCGGGCCGG
CGCGGCGCGACACCGGGCTCCGGAACCACTGCACGACGGGGCTGGACTGACCTGAAAAAAATGTCTGGATTTCTA
GAGGGCTTGAGATGCTCAGAATGCATTGACTGGGGGGAAAAGCGCAATACTATTGCTTCCATTGCTGCTGGTGTA
CTATTTTTTACAGGCTGGTGGATTATCATAGATGCAGCTGTTATTTATCCCACCATGAAAGATTTCAACCACTCA
TACCATGCCTGTGGTGTTATAGCAACCATAGCCTTCCTAATGATTAATGCAGTATCGAATGGACAAGTCCGAGGT
GATAGTTACAGTGAAGGTTGTCTGGGTCAAACAGGTGCTCGCATTTGGCTTTTCGTTGGTTTCATGTTGGCCTTT
GGATCTCTGATTGCATCTATGTGGATTCTTTTTGGAGGTTATGTTGCTAAAGAAAAAGACATAGTATACCCTGGA
ATTGCTGTATTTTTCCAGAATGCCTTCATCTTTTTTGGAGGGCTGGTTTTTAAGTTTGGCCGCACTGAAGACTTA
TGGCAGTGAACACATCTGATTTCCCACAGCACAACAGCCCTGCATGGGTTTGTTTGTTTTTTTACTGCTCACTCC
CAACCTTTTGTAATGCCATTTTCTAAACTTATTTCTGAGTGTAGTCTCAGCTTAAAGTTGTGTAATACTAAAATC
ACGAGAACACCTAAACAACAACCAAAAATCTATTGTGGTATGCACTTGATTAACTTATAAAATGTTAGAGGAAAC
TTTCACATGAATAATTTTTGTCAAATTTTATCATGGTATAATTTGTAAAAATAAAAAGAAATTACAAAAGAAATT
ATGGATTTGTCAATGTAAGTATTTGTCATATCTGAGGTCCAAAACCACAATGAAAGTGCTCTGAAGATTTAATGT
GTTTATTCAAATGTGGTCTCTTCTGTGTCAAATGTTAAATGAAATATAAACATTTTTTAGTTTTTAAAATATTCC
GTGGTCAAAATTCTTCCTCACTATAATTGGTATTTACTTTTACCAAAAATTCTGTGAACATGTAATGTAACTGGC
TTTTGAGGGTCTCCCAAGGGGTGAGTGGACGTGTTGGAAGAGAGAAGCACCATGGTCCAGCCACCAGGCTCCCTG
TGTCCCTTCCATGGGAAGGTCTTCCGCTGTGCCTCTCATTCCAAGGGCAGGAAGATGTGACTCAGCCATGACACG
TGGTTCTGGTGGGATGCACAGTCACTCCACATCCACCACTG

FIGURE 90

MSGFLEGLRCSECIDWGEKRNTIASIAAGVLFFTGWWIIIDAAVIYPTMKDFNHSYHACGVIATIAFLMINAVSN
GQVRGDSYSEGCLGQTGARIWLFVGFMLAFGSLIASMWILFGGYVAKEKDIVYPGIAVFFQNAFIFFGGLVFKFG
RTEDLWQ

FIGURE 91

CGACGCCGGCGTGATGTGGCTTCCGCTGGTGCTGCTCCTGGCTGTGCTGCTGCTGGCCGTCCTCTGCAAAGTTTA
CTTGGGACTATTCTCTGGCAGCTCCCCGAATCCTTTCTCCGAAGATGTCAAACGGCCCCCAGCGCCCCTGGTAAC
TGACAAGGAGGCCAGGAAGAAGGTTCTCAAACAAGCTTTTTCAGCCAACCAAGTGCCGGAGAAGCTGGATGTGGT
GGTAATTGGCAGTGGCTTTGGGGGCCTGGCTGCAGCTGCAATTCTAGCTAAAGCTGGCAAGCGAGTCCTGGTGCT
GGAACAACATACCAAGGCAGGGGGCTGCTGTCATACCTTTGGAAAGAATGGCCTTGAATTTGACACAGGAATCCA
TTACATTGGGCGTATGGAAGAGGGCAGCATTGGCCGTTTTATCTTGGACCAGATCACTGAAGGGCAGCTGGACTG
GGCTCCCCTGTCCTCTCCTTTTGACATCATGGTACTGGAAGGGCCCAATGGCCGAAAGGAGTACCCCATGTACAG
TGGAGAGAAAGCCTACATTCAGGGCCTCAAGGAGAAGTTTCCACAGGAGGAAGCTATCATTGACAAGTATATAAA
GCTGGTTAAGGTGGTATCCAGTGGAGCCCCTCATGCCATCCTGTTGAAATTCCTCCCATTGCCCGTGGTTCAGCT
CCTCGACAGGTGTGGGCTGCTGACTCGTTTCTCTCCATTCCTTCAAGCATCCACCCAGAGCCTGGCTGAGGTCCT
GCAGCAGCTGGGGGCCTCCTCTGAGCTCCAGGCAGTACTCAGCTACATCTTCCCCACTTACGGTGTCACCCCCAA
CCACAGTGCCTTTTCCATGCACGCCCTGCTGGTCAACCACTACATGAAAGGAGGCTTTTATCCCCGAGGGGGTTC
CAGTGAAATTGCCTTCCACACCATCCCTGTGATTCAGCGGGCTGGGGGCGCTGTCCTCACAAAGGCCACTGTGCA
GAGTGTGTTGCTGGACTCAGCTGGGAAAGCCTGTGGTGTCAGTGTGAAGAAGGGGCATGAGCTGGTGAACATCTA
TTGCCCCATCGTGGTCTCCAACGCAGGACTGTTCAACACCTATGAACACCTACTGCCGGGGAACGCCCGCTGCCT
GCCAGGTGTGAAGCAGCAACTGGGGACGGTGCGGCCCGGCTTAGGCATGACCTCTGTTTTCATCTGCCTGCGAGG
CACCAAGGAAGACCTGCATCTGCCGTCCACCAACTACTATGTTTACTATGACACGGACATGGACCAGGCGATGGA
GCGCTACGTCTCCATGCCCAGGGAAGAGGCTGCGGAACACATCCCTCTTCTCTTCTTCGCTTTCCCATCAGCCAA
AGATCCGACCTGGGAGGACCGATTCCCAGGCCGGTCCACCATGATCATGCTCATACCCACTGCCTACGAGTGGTT
TGAGGAGTGGCAGGCGGAGCTGAAGGGAAAGCGGGGCAGTGACTATGAGACCTTCAAAAACTCCTTTGTGGAAGC
CTCTATGTCAGTGGTCCTGAAACTGTTCCCACAGCTGGAGGGGAAGGTGGAGAGTGTGACTGCAGGATCCCCACT
CACCAACCAGTTCTATCTGGCTGCTCCCCGAGGTGCCTGCTACGGGGCTGACCATGACCTGGGCCGCCTGCACCC
TTGTGTGATGGCCTCCTTGAGGGCCCAGAGCCCCATCCCCAACCTCTATCTGACAGGCCAGGATATCTTCACCTG
TGGACTGGTCGGGGCCCTGCAAGGTGCCCTGCTGTGCAGCAGCGCCATCCTGAAGCGGAACTTGTACTCAGACCT
TAAGAATCTTGATTCTAGGATCCGGGCACAGAAGAAAAAGAATTAGTTCCATCAGGGAGGAGTCAGAGGAATTTG
CCCAATGGCTGGGGCATCTCCCTTGACTTACCCATAATGTCTTTCTGCATTAGTTCCTTGCACGTATAAAGCACT
CTAATTTGGTTCTGATGCCTGAAGAGAGGCCTAGTTTAAATCACAATTCCGAATCTGGGGCAATGGAATCACTGC
TTCCAGCTGGGGCAGGTGAGATCTTTACGCCTTTTATAACATGCCATCCCTACTAATAGGATATTGACTTGGATA
GCTTGATGTCTCATGACGAGCGGCGCTCTGCATCCCTCACCCATGCCTCCTAACTCAGTGATCAAAGCGAATATT
CCATCTGTGGATAGAACCCCTGGCAGTGTTGTCAGCTCAACCTGGTGGGTTCAGTTCTGTCCTGAGGCTTCTGCT
CTCATTCATTTAGTGCTACGCTGCACAGTTCTACACTGTCAAGGGAAAAGGGAGACTAATGAGGCTTAACTCAAA
ACCTGGGCGTGGTTTTGGTTGCCATTCCATAGGTTTGGAGAGCTCTAGATCTCTTTTGTGCTGGGTTCAGTGGCT
CTTCAGGGGACAGGAAATGCCTGTGTCTGGCCAGTGTGGTTCTGGAGCTTTGGGGTAACAGCAGGATCCATCAGT
TAGTAGGGTGCATGTCAGATGATCATATCCAATTCATATGGAAGTCCCGGGTCTGTCTTCCTTATCATCGGGGTG
GCAGCTGGTTCTCAATGTGCCAGCAGGGACTCAGTACCTGAGCCTCAATCAAGCCTTATCCACCAAATACACAGG
GAAGGGTGATGCAGGGAAGGGTGACATCAGGAGTCAGGGCATGGACTGGTAAGATGAATACTTTGCTGGGCTGAA
GCAGGCTGCAGGGCATTCCAGCCAAGGGCACAGCAGGGGACAGTGCAGGGAGGTGTGGGGTAAGGGAGGGAAGTC
ACATCAGAAAAGGGAAAGCCACGGAATGTGTGTGAAGCCCAGAAATGGCATTTGCAGTTAATTAGCACATGTGAG
GGTTAGACAGGTAGGTGAATGCAAGCTCAAGGTTTGGAAAAATGACTTTTCAGTTATGTCTTTGGTATCAGACAT
ACGAAAGGTCTCTTTGTAGTTCGTGTTAATGTAACATTAATAAATTTATTGATTCCATTGCTTTAAAAAAAAAAA
AAAA

FIGURE 92

MWLPLVLLLAVLLLAVLCKVYLGLFSGSSPNPFSEDVKRPPAPLVTDKEARKKVLKQAFSANQVPEKLDVVVIGS
GFGGLAAAAILAKAGKRVLVLEQHTKAGGCCHTFGKNGLEFDTGIHYIGRMEEGSIGRFILDQITEGQLDWAPLS
SPFDIMVLEGPNGRKEYPMYSGEKAYIQGLKEKFPQEEAIIDKYIKLVKVVSSGAPHAILLKFLPLPVVQLLDRC
GLLTRFSPFLQASTQSLAEVLQQLGASSELQAVLSYIFPTYGVTPNHSAFSMHALLVNHYMKGGFYPRGGSSEIA
FHTIPVIQRAGGAVLTKATVQSVLLDSAGKACGVSVKKGHELVNIYCPIVVSNAGLFNTYEHLLPGNARCLPGVK
QQLGTVRPGLGMTSVFICLRGTKEDLHLPSTNYYVYYDTDMDQAMERYVSMPREEAAEHIPLLFFAFPSAKDPTW
EDRFPGRSTMIMLIPTAYEWFEEWQAELKGKRGSDYETFKNSFVEASMSVVLKLFPQLEGKVESVTAGSPLTNQF
YLAAPRGACYGADHDLGRLHPCVMASLRAQSPIPNLYLTGQDIFTCGLVGALQGALLCSSAILKRNLYSDLKNLD
SRIRAQKKKN

FIGURE 93

GGGAAAGATGGCGGCGACTCTGGGACCCCTTGGGTCGTGGCAGCAGTGGCGGCGATGTTTGTCGGCTCGGGATGG
GTCCAGGATGTTACTCCTTCTTCTTTTGTTGGGGTCTGGGCAGGGGCCACAGCAAGTCGGGGCGGGTCAAACGTT
CGAGTACTTGAAACGGGAGCACTCGCTGTCGAAGCCCTACCAGGGTGTGGGCACAGGCAGTTCCTCACTGTGGAA
TCTGATGGGCAATGCCATGGTGATGACCCAGTATATCCGCCTTACCCCAGATATGCAAAGTAAACAGGGTGCCTT
GTGGAACCGGGTGCCATGTTTCCTGAGAGACTGGGAGTTGCAGGTGCACTTCAAAATCCATGGACAAGGAAAGAA
GAATCTGCATGGGGATGGCTTGGCAATCTGGTACACAAAGGATCGGATGCAGCCAGGGCCTGTGTTTGGAAACAT
GGACAAATTTGTGGGGCTGGGAGTATTTGTAGACACCTACCCCAATGAGGAGAAGCAGCAAGAGCGGGTATTCCC
CTACATCTCAGCCATGGTGAACAACGGCTCCCTCAGCTATGATCATGAGCGGGATGGGCGGCCTACAGAGCTGGG
AGGCTGCACAGCCATTGTCCGCAATCTTCATTACGACACCTTCCTGGTGATTCGCTACGTCAAGAGGCATTTGAC
GATAATGATGGATATTGATGGCAAGCATGAGTGGAGGGACTGCATTGAAGTGCCCGGAGTCCGCCTGCCCCGCGG
CTACTACTTCGGCACCTCCTCCATCACTGGGGATCTCTCAGATAATCATGATGTCATTTCCTTGAAGTTGTTTGA
ACTGACAGTGGAGAGAACCCCAGAAGAGGAAAAGCTCCATCGAGATGTGTTCTTGCCCTCAGTGGACAATATGAA
GCTGCCTGAGATGACAGCTCCACTGCCGCCCCTGAGTGGCCTGGCCCTCTTCCTCATCGTCTTTTTCTCCCTGGT
GTTTTCTGTATTTGCCATAGTCATTGGTATCATACTCTACAACAAATGGCAGGAACAGAGCCGAAAGCGCTTCTA
CTGAGCCCTCCTGCTGCCACCACTTTTGTGACTGTCACCCATGAGGTATGGAAGGAGCAGGCACTGGCCTGAGCA
TGCAGCCTGGAGAGTGTTCTTGTCTCTAGCAGCTGGTTGGGGACTATATTCTGTCACTGGAGTTTTGAATGCAGG
GACCCCGCATTCCCATGGTTGTGCATGGGGACATCTAACTCTGGTCTGGGAAGCCACCCACCCCAGGGCAATGCT
GCTGTGATGTGCCTTTCCCTGCAGTCCTTCCATGTGGGAGCAGAGGTGTGAAGAGAATTTACGTGGTTGTGATGC
CAAAATCACAGAACAGAATTTCATAGCCCAGGCTGCCGTGTTGTTTGACTCAGAAGGCCCTTCTACTTCAGTTTT
GAATCCACAAAGAATTAAAAACTGGTAACACCACAGGCTTTCTGACCATCCATTCGTTGGGTTTTGCATTTGACC
CAACCCTCTGCCTACCTGAGGAGCTTTCTTTGGAAACCAGGATGGAAACTTCTTCCCTGCCTTACCTTCCTTTCA
CTCCATTCATTGTCCTCTCTGTGTGCAACCTGAGCTGGGAAAGGCATTTGGATGCCTCTCTGTTGGGGCCTGGGG
CTGCAGAACACACCTGCGTTTCACTGGCCTTCATTAGGTGGCCCTAGGGAGATGGCTTTCTGCTTTGGATCACTG
TTCCCTAGCATGGGTCTTGGGTCTATTGGCATGTCCATGGCCTTCCCAATCAAGTCTCTTCAGGCCCTCAGTGAA
GTTTGGCTAAAGGTTGGTGTAAAAATCAAGAGAAGCCTGGAAGACATCATGGATGCCATGGATTAGCTGTGCAAC
TGACCAGCTCCAGGTTTGATCAAACCAAAAGCAACATTTGTCATGTGGTCTGACCATGTGGAGATGTTTCTGGAC
TTGCTAGAGCCTGCTTAGCTGCATGTTTTGTAGTTACGATTTTTGGAATCCCACTTTGAGTGCTGAAAGTGTAAG
GAAGCTTTCTTCTTACACCTTGGGCTTGGATATTGCCCAGAGAAGAAATTTGGCTTTTTTTTTCTTAATGGACAA
GAGACAGTTGCTGTTCTCATGTTCCAAGTCTGAGAGCAACAGACCCTCATCATCTGTGCCTGGAAGAGTTCACTG
TCATTGAGCAGCACAGCCTGAGTGCTGGCCTCTGTCAACCCTTATTCCACTGCCTTATTTGACAAGGGGTTACAT
GCTGCTCACCTTACTGCCCTGGGATTAAATCAGTTACAGGCCAGAGTCTCCTTGGAGGGCCTGGAACTCTGAGTC
CTCCTATGAACCTCTGTAGCCTAAATGAAATTCTTAAAATCACCGATGGAACCAAAAAAAAAAAAAAAAAAGGGCG
GCCGCGACTCTAGAGTCGACCTGCAGTAGGGATAACAGGGTAATAAGCTTGGCCGCCATGG

FIGURE 94

></usr/seqdb2/sst/DNA/Dnaseqs.min/ss.DNA50911
><subunit 1 of 1, 348 aa, 1 stop
><MW: 39711, pI: 8.70, NX(S/T): 1
MAATLGPLGSWQQWRRCLSARDGSRMLLLLLLLGSGQGPQQVGAGQTFEYLKREHSLSKPYQGVGTGSSSLWNLM
GNAMVMTQYIRLTPDMQSKQGALWNRVPCFLRDWELQVHFKIHGQGKKNLHGDGLAIWYTKDRMQPGPVFGNMDK
FVGLGVFVDTYPNEEKQQERVFPYISAMVNNGSLSYDHERDGRPTELGGCTAIVRNLHYDTFLVIRYVKRHLTIM
MDIDGKHEWRDCIEVPGVRLPRGYYFGTSSITGDLSDNHDVISLKLFELTVERTPEEEKLHRDVFLPSVDNMKLP
EMTAPLPPLSGLALFLIVFFSLVFSVFAIVIGIILYNKWQEQSRKRFY

Signal sequence:
amino acids 1-38

Transmembrane domain:
amino acids 310-329

FIGURE 95

CCTGTGTTAAGCTGAGGTTTCCCCTAGATCTCGTATATCCCCAACACATACCTCCACGCACACACATCCCCAAGA
ACCTCGAGCTCACACCAACAGACACACGCGCGCATACACACTCGCTCTCGCTTGTCCATCTCCCTCCCGGGGGAG
CCGGCGCGCGCTCCCACCTTTGCCGCACACTCCGGCGAGCCGAGCCCGCAGCGCTCCAGGATTCTGCGGCTCGGA
ACTCGGATTGCAGCTCTGAACCCCCATGGTGGTTTTTAAACACTTCTTTTCCTTCTCTTCCTCGTTTTGATTGC
ACCGTTTCCATCTGGGGGCTAGAGGAGCAAGGCAGCAGCCTTCCCAGCCAGCCCTTGTTGGCTTGCCATCGTCCA
TCTGGCTTATAAAAGTTTGCTGAGCGCAGTCCAGAGGGCTGCGCTGCTCGTCCCCTCGGCTGGCAGAAGGGGGTG
ACGCTGGGCAGCGGCGAGGAGCGCGCCGCTGCCTCTGGCGGGCTTTCGGCTTGAGGGGCAAGGTGAAGAGCGCAC
CGGCCGTGGGGTTTACCGAGCTGGATTTGTATGTTGCACCATGCCTTCTTGGATCGGGGCTGTGATTCTTCCCCT
CTTGGGGCTGCTGCTCTCCCTCCCCGCCGGGGCGGATGTGAAGGCTCGGAGCTGCGGAGAGGTCCGCCAGGCGTA
CGGTGCCAAGGGATTCAGCCTGGCGGACATCCCCTACCAGGAGATCGCAGGGGAACACTTAAGAATCTGTCCTCA
GGAATATACATGCTGCACCACAGAAATGGAAGACAAGTTAAGCCAACAAAGCAAACTCGAATTTGAAAACCTTGT
GGAAGAGACAAGCCATTTTGTGCGCACCACTTTTGTGTCCAGGCATAAGAAATTTGACGAATTTTTCCGAGAGCT
CCTGGAGAATGCAGAAAAGTCACTAAATGATATGTTTGTACGGACCTATGGCATGCTGTACATGCAGAATTCAGA
AGTCTTCCAGGACCTCTTCACAGAGCTGAAAAGGTACTACACTGGGGGTAATGTGAATCTGGAGGAAATGCTCAA
TGACTTTTGGGCTCGGCTCCTGGAACGGATGTTTCAGCTGATAAACCCTCAGTATCACTTCAGTGAAGACTACCT
GGAATGTGTGAGCAAATACACTGACCAGCTCAAGCCATTTGGAGACGTGCCCCGGAAACTGAAGATTCAGGTTAC
CCGCGCCTTCATTGCTGCCAGGACCTTTGTCCAGGGGCTGACTGTGGCAGAGAAGTTGCAAACCGAGTTTCCAA
GGTCAGCCCAACCCCAGGGTGTATCCGTGCCCTCATGAAGATGCTGTACTGCCCATACTGTCGGGGGCTTCCCAC
TGTGAGGCCCTGCAACAACTACTGTCTCAACGTCATGAAGGGCTGCTTGGCAAATCAGGCTGACCTCGACACAGA
GTGGAATCTGTTTATAGATGCAATGCTCTTGGTGGCAGAGCGACTGGAGGGGCCATTCAACATTGAGTCGGTCAT
GGACCCGATAGATGTCAAGATTTCTGAAGCCATTATGAACATGCAAGAAAACAGCATGCAGGTGTCTGCAAAGGT
CTTTCAGGGATGTGGTCAGCCCAAACCTGCTCCAGCCCTCAGATCTGCCCGCTCAGCTCCTGAAAATTTTAATAC
ACGTTTCAGGCCCTACAATCCTGAGGAAAGACCAACAACTGCTGCAGGCACAAGCTTGGACCGGCTGGTCACAGA
CATAAAAGAGAAATTGAAGCTCTCTAAAAAGGTCTGGTCAGCATTACCCTACACTATCTGCAAGGACGAGAGCGT
GACAGCGGGCACGTCCAACGAGGAGGAATGCTGGAACGGGCACAGCAAAGCCAGATACTTGCCTGAGATCATGAA
TGATGGGCTCACCAACCAGATCAACAATCCCGAGGTGGATGTGGACATCACTCGGCCTGACACTTTCATCAGACA
GCAGATTATGGCTCTCCGTGTGATGACCAACAAACTAAAAAACGCCTACAATGGCAATGATGTCAATTTCCAGGA
CACAAGTGATGAATCCAGTGGCTCAGGGAGTGGCAGTGGGTGCATGGATGACGTGTGTCCCACGGAGTTTGAGTT
TGTCACCACAGAGGCCCCCGCAGTGGATCCCGACCGGAGAGAGGTGGACTCTTCTGCAGCCCAGCGTGGCCACTC
CCTGCTCTCCTGGTCTCTCACCTGCATTGTCCTGGCACTGCAGAGACTGTGCAGATAATCTTGGGTTTTTGGTCA
GATGAAACTGCATTTTAGCTATCTGAATGGCCAACTCACTTCTTTTCTTACACTCTTGGACAATGGACCATGCCA
CAAAAACTTACCGTTTTCTATGAGAAGAGAGCAGTAATGCAATCTGCCTCCCTTTTTGTTTTCCCAAAGAGTACC
GGGTGCCAGACTGAACTGCTTCCTCTTTCCTTCAGCTATCTGTGGGGACCTTGTTTATTCTAGAGAGAATTCTTA
CTCAAATTTTTCGTACCAGGAGATTTTCTTACCTTCATTTGCTTTTATGCTGCAGAAGTAAAGGAATCTCACGTT
GTGAGGGTTTTTTTTTCTCATTTAAAAT

FIGURE 96

></usr/seqdb2/sst/DNA/Dnaseqs.min/ss.DNA50914
><subunit 1 of 1, 555 aa, 1 stop
><MW: 62736, pI: 5.36, NX(S/T): 0
MPSWIGAVILPLLGLLLSLPAGADVKARSCGEVRQAYGAKGFSLADIPYQEIAGEHLRICPQEYTCCTTEMEDKL
SQQSKLEFENLVEETSHFVRTTFVSRHKKFDEFFRELLENAEKSLNDMFVRTYGMLYMQNSEVFQDLFTELKRYY
TGGNVNLEEMLNDFWARLLERMFQLINPQYHFSEDYLECVSKYTDQLKPFGDVPRKLKIQVTRAFIAARTFVQGL
TVGREVANRVSKVSPTPGCIRALMKMLYCPYCRGLPTVRPCNNYCLNVMKGCLANQADLDTEWNLFIDAMLLVAE
RLEGPFNIESVMDPIDVKISEAIMNMQENSMQVSAKVFQGCGQPKPAPALRSARSAPENFNTRFRPYNPEERPTT
AAGTSLDRLVTDIKEKLKLSKKVWSALPYTICKDESVTAGTSNEEECWNGHSKARYLPEIMNDGLTNQINNPEVD
VDITRPDTFIRQQIMALRVMTNKLKNAYNGNDVNFQDTSDESSGSGSGSGCMDDVCPTEFEFVTTEAPAVDPDRR
EVDSSAAQRGHSLLSWSLTCIVLALQRLCR

Signal peptide:
amino acids 1-23

FIGURE 97

GGCGGCGTCCGTGAGGGGCTCCTTTGGGCAGGGGTAGTGTTTGGTGTCCCTGTCTTGCGTGATATTGACAAACTG
AAGCTTTCCTGCACCACTGGACTTAAGGAAGAGTGTACTCGTAGGCGGACAGCTTTAGTGGCCGGCCGGCCGCTC
TCATCCCCCGTAAGGAGCAGAGTCCTTTGTACTGACCAAGATGAGCAACATCTACATCCAGGAGCCTCCCACGAA
TGGGAAGGTTTTATTGAAAACTACAGCTGGAGATATTGACATAGAGTTGTGGTCCAAAGAAGCTCCTAAAGCTTG
CAGAAATTTTATCCAACTTTGTTTGGAAGCTTATTATGACAATACCATTTTTCATAGAGTTGTGCCTGGTTTCAT
AGTCCAAGGCGGAGATCCTACTGGCACAGGGAGTGGTGGAGAGTCTATCTATGGAGCGCCATTCAAAGATGAATT
TCATTCACGGTTGCGTTTTAATCGGAGAGGACTGGTTGCCATGGCAAATGCTGGTTCTCATGATAATGGCAGCCA
GTTTTTCTTCACACTGGGTCGAGCAGATGAACTTAACAATAAGCATACCATCTTTGGAAAGGTTACAGGGGATAC
AGTATATAACATGTTGCGACTGTCAGAAGTAGACATTGATGATGACGAAAGACCACATAATCCACACAAAATAAA
AAGCTGTGAGGTTTTGTTTAATCCTTTTGATGACATCATTCCAAGGGAAATTAAAAGGCTGAAAAAAGAGAAACC
AGAGGAGGAAGTAAAGAAATTGAAACCCAAAGGCACAAAAAATTTTAGTTTACTTTCATTTGGAGAGGAAGCTGA
GGAAGAAGAGGAGGAAGTAAATCGAGTTAGTCAGAGCATGAAGGGCAAAAGCAAAAGTAGTCATGACTTGCTTAA
GGATGATCCACATCTCAGTTCTGTTCCAGTTGTAGAAAGTGAAAAAGGTGATGCACCAGATTTAGTTGATGATGG
AGAAGATGAAAGTGCAGAGCATGATGAATATATTGATGGTGATGAAAAGAACCTGATGAGAGAAAGAATTGCCAA
AAAATTAAAAAAGGACACAAGTGCGAATGTTAAATCAGCTGGAGAAGGAGAAGTGGAGAAGAAATCAGTCAGCCG
CAGTGAAGAGCTCAGAAAAGAAGCAAGACAATTAAAACGGGAACTCTTAGCAGCAAAACAAAAAAAAGTAGAAAA
TGCAGCAAAACAAGCAGAAAAAAGAAGTGAAGAGGAAGAAGCCCCTCCAGATGGTGCTGTTGCCGAATACAGAAG
AGAAAAGCAAAAGTATGAAGCTTTGAGGAAGCAACAGTCAAAGAAGGGAACTTCCCGGGAAGATCAGACCCTTGC
ACTGCTGAACCAGTTTAAATCTAAACTCACTCAAGCAATTGCTGAAACACCTGAAAATGACATTCCTGAAACAGA
AGTAGAAGATGATGAAGGATGGATGTCACATGTACTTCAGTTTGAGGATAAAAGCAGAAAAGTGAAAGATGCAAG
CATGCAAGACTCAGATACATTTGAAATCTATGATCCTCGGAATCCAGTGAATAAAAGAAGGAGGGAAGAAAGCAA
AAAGCTGATGAGAGAGAAAAAAGAAAGAAGATAAAATGAGAATAATGATAACCAGAACTTGCTGGAAATGTGCCT
ACAATGGCCTTGTAACAGCCATTGTTCCCAACAGCATCACTTAGGGGTGTGAAAAGAAGTATTTTTGAACCTGTT
GTCTGGTTTTGAAAAACAATTATCTTGTTTTGCAAATTGTGGAATGATGTAAGCAAATGCTTTTGGTTACTGGTA
CATGTGTTTTTTCCTAGCTGACCTTTTATATTGCTAAATCTGAAATAAAATAACTTTCCTTCCACAAAAAAAAAA
AAAAAAAAAAAAAAAAAAA

FIGURE 98

></usr/seqdb2/sst/DNA/Dnaseqs.min/ss.DNA50919
><subunit 1 of 1, 472 aa, 1 stop
><MW: 53847, pI: 5.75, NX(S/T): 2
MSNIYIQEPPTNGKVLLKTTAGDIDIELWSKEAPKACRNFIQLCLEAYYDNTIFHRVVPGFIVQGGDPTGTGSGG
ESIYGAPFKDEFHSRLRFNRRGLVAMANAGSHDNGSQFFFTLGRADELNNKHTIFGKVTGDTVYNMLRLSEVDID
DDERPHNPHKIKSCEVLFNPFDDIIPREIKRLKKEKPEEEVKKLKPKGTKNFSLLSFGEEAEEEEEEVNRVSQSM
KGKSKSSHDLLKDDPHLSSVPVVESEKGDAPDLVDDGEDESAEHDEYIDGDEKNLMRERIAKKLKKDTSANVKSA
GEGEVEKKSVSRSEELRKEARQLKRELLAAKQKKVENAAKQAEKRSEEEEAPPDGAVAEYRREKQKYEALRKQQS
KKGTSREDQTLALLNQFKSKLTQAIAETPENDIPETEVEDDEGWMSHVLQFEDKSRKVKDASMQDSDTFEIYDPR
NPVNKRRREESKKLMREKKERR

Important features:
Signal peptide:
amino acids 1-21

N-glycosylation sites.
amino acids 109-112 and 201-204

Cyclophilin-type peptidyl-prolyl cis-trans isomerase signature.
amino acids 49-66

Homologous region to Cyclophilin-type peptidyl-prolyl cis-trans isomerase
amino acids 96-140, 49-89 and 22-51

FIGURE 99

CTTTTCTGAGGAACCACAGCAATGAATGGCTTTGCATCCTTGCTTCGAAGAAACCAATTTATCCTCCTGGTACTA
TTTCTTTTGCAAATTCAGAGTCTGGGTCTGGATATTGATAGCCGTCCTACCGCTGAAGTCTGTGCCACACACACA
ATTTCACCAGGACCCAAAGGAGATGATGGTGAAAAAGGAGATCCAGGAGAAGAGGGAAAGCATGGCAAAGTGGGA
CGCATGGGGCCGAAAGGAATTAAAGGAGAACTGGGTGATATGGGAGATCAGGGCAATATTGGCAAGACTGGGCCC
ATTGGGAAGAAGGGTGACAAAGGGGAAAAAGGTTTGCTTGGAATACCTGGAGAAAAAGGCAAAGCAGGTACTGTC
TGTGATTGTGGAAGATACCGGAAATTTGTTGGACAACTGGATATTAGTATTGCTCGGCTCAAGACATCTATGAAG
TTTGTCAAGAATGTGATAGCAGGGATTAGGGAAACTGAAGAGAAATTCTACTACATCGTGCAGGAAGAGAAGAAC
TACAGGGAATCCCTAACCCACTGCAGGATTCGGGGTGGAATGCTAGCCATGCCCAAGGATGAAGCTGCCAACACA
CTCATCGCTGACTATGTTGCCAAGAGTGGCTTCTTTCGGGTGTTCATTGGCGTGAATGACCTTGAAAGGGAGGGA
CAGTACATGTCCACAGACAACACTCCACTGCAGAACTATAGCAACTGGAATGAGGGGGAACCCAGCGACCCCTAT
GGTCATGAGGACTGTGTGGAGATGCTGAGCTCTGGCAGATGGAATGACACAGAGTGCCATCTTACCATGTACTTT
GTCTGTGAGTTCATCAAGAAGAAAAAGTAACTTCCCTCATCCTACGTATTTGCTATTTTCCTGTGACCGTCATTA
CAGTTATTGTTATCCATCCTTTTTTTCCTGATTGTACTACATTTGATCTGAGTCAACATAGCTAGAAAATGCTAA
ACTGAGGTATGGAGCCTCCATCATCAAAAAAAAAAAAAAAA

FIGURE 100

```
></usr/seqdb2/sst/DNA/Dnaseqs.min/ss.DNA50980
><subunit 1 of 1, 277 aa, 1 stop
><MW: 30645, pI: 7.47, NX(S/T): 2
MNGFASLLRRNQFILLVLFLLQIQSLGLDIDSRPTAEVCATHTISPGPKGDDGEKGDPGEEGKHGKVGRMGPKGI
KGELGDMGDQGNIGKTGPIGKKGDKGEKGLLGIPGEKGKAGTVCDCGRYRKFVGQLDISIARLKTSMKFVKNVIA
GIRETEEKFYYIVQEEKNYRESLTHCRIRGGMLAMPKDEAANTLIADYVAKSGFFRVFIGVNDLEREGQYMSTDN
TPLQNYSNWNEGEPSDPYGHEDCVEMLSSGRWNDTECHLTMYFVCEFIKKKK
```

Signal peptide:
amino acids 1-25

FIGURE 101

GCAACCTCAGCTTCTAGTATCCAGACTCCAGCGCCGCCCCGGGCGCGGACCCCAACCCCGACCCAGAGCTTCTCC
AGCGGCGGCGCAGCGAGCAGGGCTCCCCGCCTTAACTTCCTCCGCGGGGCCCAGCCACCTTCGGGAGTCCGGGTT
GCCCACCTGCAAACTCTCCGCCTTCTGCACCTGCCACCCCTGAGCCAGCGCGGGCCCCCGAGCGAGTCATGGCCA
ACGCGGGGCTGCAGCTGTTGGGCTTCATTCTCGCCTTCCTGGGATGGATCGGCGCCATCGTCAGCACTGCCCTGC
CCCAGTGGAGGATTTACTCCTATGCCGGCGACAACATCGTGACCGCCCAGGCCATGTACGAGGGGCTGTGGATGT
CCTGCGTGTCGCAGAGCACCGGGCAGATCCAGTGCAAAGTCTTTGACTCCTTGCTGAATCTGAGCAGCACATTGC
AAGCAACCCGTGCCTTGATGGTGGTTGGCATCCTCCTGGGAGTGATAGCAATCTTTGTGGCCACCGTTGGCATGA
AGTGTATGAAGTGCTTGGAAGACGATGAGGTGCAGAAGATGAGGATGGCTGTCATTGGGGGTGCGATATTTCTTC
TTGCAGGTCTGGCTATTTTAGTTGCCACAGCATGGTATGGCAATAGAATCGTTCAAGAATTCTATGACCCTATGA
CCCCAGTCAATGCCAGGTACGAATTTGGTCAGGCTCTCTTCACTGGCTGGGCTGCTGCTTCTCTCTGCCTTCTGG
GAGGTGCCCTACTTTGCTGTTCCTGTCCCCGAAAAACAACCTCTTACCCAACACCAAGGCCCTATCCAAAACCTG
CACCTTCCAGCGGGAAAGACTACGTGTGACACAGAGGCAAAAGGAGAAAATCATGTTGAAACAAACCGAAAATGG
ACATTGAGATACTATCATTAACATTAGGACCTTAGAATTTTGGGTATTGTAATCTGAAGTATGGTATTACAAAAC
AAACAAACAAACAAAAAACCCATGTGTTAAAATACTCAGTGCTAAACATGGCTTAATCTTATTTTATCTTCTTTC
CTCAATATAGGAGGGAAGATTTTTCCATTTGTATTACTGCTTCCCATTGAGTAATCATACTCAAATGGGGGAAGG
GGTGCTCCTTAAATATATATAGATATGTATATATACATGTTTTTCTATTAAAAATAGACAGTAAAATACTATTCT
CATTATGTTGATACTAGCATACTTAAAATATCTCTAAAATAGGTAAATGTATTTAATTCCATATTGATGAAGATG
TTTATTGGTATATTTTCTTTTTCGTCCTTATATACATATGTAACAGTCAAATATCATTTACTCTTCTTCATTAGC
TTTGGGTGCCTTTGCCACAAGACCTAGCCTAATTTACCAAGGATGAATTCTTTCAATTCTTCATGCGTGCCCTTT
TCATATACTTATTTTATTTTTTACCATAATCTTATAGCACTTGCATCGTTATTAAGCCCTTATTTGTTTTGTGTT
TCATTGGTCTCTATCTCCTGAATCTAACACATTTCATAGCCTACATTTTAGTTTCTAAAGCCAAGAAGAATTTAT
TACAAATCAGAACTTTGGAGGCAAATCTTTCTGCATGACCAAAGTGATAAATTCCTGTTGACCTTCCCACACAAT
CCCTGTACTCTGACCCATAGCACTCTTGTTTGCTTTGAAAATATTTGTCCAATTGAGTAGCTGCATGCTGTTCCC
CCAGGTGTTGTAACACAACTTTATTGATTGAATTTTTAAGCTACTTATTCATAGTTTTATATCCCCCTAAACTAC
CTTTTTGTTCCCCATTCCTTAATTGTATTGTTTTCCCAAGTGTAATTATCATGCGTTTTATATCTTCCTAATAAG
GTGTGGTCTGTTTGTCTGAACAAAGTGCTAGACTTTCTGGAGTGATAATCTGGTGACAAATATTCTCTCTGTAGC
TGTAAGCAAGTCACTTAATCTTTCTACCTCTTTTTTCTATCTGCCAAATTGAGATAATGATACTTAACCAGTTAG
AAGAGGTAGTGTGAATATTAATTAGTTTATATTACTCTTATTCTTTGAACATGAACTATGCCTATGTAGTGTCTT
TATTTGCTCAGCTGGCTGAGACACTGAAGAAGTCACTGAACAAAACCTACACACGTACCTTCATGTGATTCACTG
CCTTCCTCTCTCTACCAGTCTATTTCCACTGAACAAAACCTACACACATACCTTCATGTGGTTCAGTGCCTTCCT
CTCTCTACCAGTCTATTTCCACTGAACAAAACCTACGCACATACCTTCATGTGGCTCAGTGCCTTCCTCTCTCTA
CCAGTCTATTTCCATTCTTTCAGCTGTGTCTGACATGTTTGTGCTCTGTTCCATTTTAACAACTGCTCTTACTTT
TCCAGTCTGTACAGAATGCTATTTCACTTGAGCAAGATGATGTAATGGAAAGGGTGTTGGCACTGGTGTCTGGAG
ACCTGGATTTGAGTCTTGGTGCTATCAATCACCGTCTGTGTTTGAGCAAGGCATTTGGCTGCTGTAAGCTTATTG
CTTCATCTGTAAGCGGTGGTTTGTAATTCCTGATCTTCCCACCTCACAGTGATGTTGTGGGGATCCAGTGAGATA
GAATACATGTAAGTGTGGTTTTGTAATTTAAAAAGTGCTATACTAAGGGAAAGAATTGAGGAATTAACTGCATAC
GTTTTGGTGTTGCTTTTCAAATGTTTGAAAATAAAAAAAATGTTAAG

FIGURE 102

></usr/seqdb2/sst/DNA/Dnaseqs.min/ss.DNA52185
><subunit 1 of 1, 211 aa, 1 stop
><MW: 22744, pI: 8.51, NX(S/T): 1
MANAGLQLLGFILAFLGWIGAIVSTALPQWRIYSYAGDNIVTAQAMYEGLWMSCVSQSTGQIQCKVFDSLLNLSS
TLQATRALMVVGILLGVIAIFVATVGMKCMKCLEDDEVQKMRMAVIGGAIFLLAGLAILVATAWYGNRIVQEFYD
PMTPVNARYEFGQALFTGWAAASLCLLGGALLCCSCPRKTTSYPTPRPYPKPAPSSGKDYV

Important features:
Signal peptide:
amino acids 1-21

Transmembrane domains:
amino acids 82-102, 118-142 and 161-187

N-glycosylation site.
amino acids 72-75

PMP-22 / EMP / MP20 family proteins
amino acids 70-111

ABC-2 type transport system integral membrane protein
amino acids 119-133

FIGURE 103

CCCACGCGTCCGCGGACGCGTGGGCTGGACCCCAGGTCTGGAGCGAATTCCAGCCTGCAGGGCTGATAAGCGAGG
CATTAGTGAGATTGAGAGAGACTTTACCCCGCCGTGGTGGTTGGAGGGCGCGCAGTAGAGCAGCAGCACAGGCGC
GGGTCCCGGGAGGCCGGCTCTGCTCGCGCCGAGATGTGGAATCTCCTTCACGAAACCGACTCGGCTGTGGCCACC
GCGCGCCGCCCGCGCTGGCTGTGCGCTGGGGCGCTGGTGCTGGCGGGTGGCTTCTTTCTCCTCGGCTTCCTCTTC
GGGTGGTTTATAAAATCCTCCAATGAAGCTACTAACATTACTCCAAAGCATAATATGAAAGCATTTTTGGATGAA
TTGAAAGCTGAGAACATCAAGAAGTTCTTACATAATTTTACACAGATACCACATTTAGCAGGAACAGAACAAAAC
TTTCAGCTTGCAAAGCAAATTCAATCCCAGTGGAAAGAATTTGGCCTGGATTCTGTTGAGCTAGCTCATTATGAT
GTCCTGTTGTCCTACCCAAATAAGACTCATCCCAACTACATCTCAATAATTAATGAAGATGGAAATGAGATTTTC
AACACATCATTATTTGAACCACCTCCTCCAGGATATGAAAATGTTTCGGATATTGTACCACCTTTCAGTGCTTTC
TCTCCTCAAGGAATGCCAGAGGGCGATCTAGTGTATGTTAACTATGCACGAACTGAAGACTTCTTTAAATTGGAA
CGGGACATGAAAATCAATTGCTCTGGGAAAATTGTAATTGCCAGATATGGGAAAGTTTTCAGAGGAAATAAGGTT
AAAAATGCCCAGCTGGCAGGGGCCAAAGGAGTCATTCTCTACTCCGACCCTGCTGACTACTTTGCTCCTGGGGTG
AAGTCCTATCCAGACGGTTGGAATCTTCCTGGAGGTGGTGTCCAGCGTGGAAATATCCTAAATCTGAATGGTGCA
GGAGACCCTCTCACACCAGGTTACCCAGCAAATGAATATGCTTATAGGCGTGGAATTGCAGAGGCTGTTGGTCTT
CCAAGTATTCCTGTTCATCCAATTGGATACTATGATGCACAGAAGCTCCTAGAAAAAATGGGTGGCTCAGCACCA
CCAGATAGCAGCTGGAGAGGAAGTCTCAAAGTGCCCTACAATGTTGGACCTGGCTTTACTGGAAACTTTTCTACA
CAAAAAGTCAAGATGCACATCCACTCTACCAATGAAGTGACGAGAATTTACAATGTGATAGGTACTCTCAGAGGA
GCAGTGGAACCAGACAGATATGTCATTCTGGGAGGTCACCGGGACTCATGGGTGTTTGGTGGTATTGACCCTCAG
AGTGGAGCAGCTGTTGTTCATGAAATTGTGAGGAGCTTTGGAACACTGAAAAAGGAAGGGTGGAGACCTAGAAGA
ACAATTTTGTTTGCAAGCTGGGATGCAGAAGAATTTGGTCTTCTTGGTTCTACTGAGTGGGCAGAGGAGAATTCA
AGACTCCTTCAAGAGCGTGGCGTGGCTTATATTAATGCTGACTCATCTATAGAAGGAAACTACACTCTGAGAGTT
GATTGTACACCGCTGATGTACAGCTTGGTACACAACCTAACAAAAGAGCTGAAAAGCCCTGATGAAGGCTTTGAA
GGCAAATCTCTTTATGAAAGTTGGACTAAAAAAAGTCCTTCCCCAGAGTTCAGTGGCATGCCCAGGATAAGCAAA
TTGGGATCTGGAAATGATTTTGAGGTGTTCTTCCAACGACTTGGAATTGCTTCAGGCAGAGCACGGTATACTAAA
AATTGGGAAACAAACAAATTCAGCGGCTATCCACTGTATCACAGTGTCTATGAAACATATGAGTTGGTGGAAAAG
TTTTATGATCCAATGTTTAAATATCACCTCACTGTGGCCCAGGTTCGAGGAGGGATGGTGTTTGAGCTAGCCAAT
TCCATAGTGCTCCCTTTTGATTGTCGAGATTATGCTGTAGTTTTAAGAAAGTATGCTGACAAAATCTACAGTATT
TCTATGAAACATCCACAGGAAATGAAGACATACAGTGTATCATTTGATTCACTTTTTTCTGCAGTAAAGAATTTT
ACAGAAATTGCTTCCAAGTTCAGTGAGAGACTCCAGGACTTTGACAAAAGCAACCCAATAGTATTAAGAATGATG
AATGATCAACTCATGTTTCTGGAAAGAGCATTTATTGATCCATTAGGGTTACCAGACAGGCCTTTTTATAGGCAT
GTCATCTATGCTCCAAGCAGCCACAACAAGTATGCAGGGGAGTCATTCCCAGGAATTTATGATGCTCTGTTTGAT
ATTGAAAGCAAAGTGGACCCTTCCAAGGCCTGGGGAGAAGTGAAGAGACAGATTTATGTTGCAGCCTTCACAGTG
CAGGCAGCTGCAGAGACTTTGAGTGAAGTAGCCTAAGAGGATTTTTTAGAGAATCCGTATTGAATTTGTGTGGTA
TGTCACTCAGAAAGAATCGTAATGGGTATATTGATAAATTTTAAAATTGGTATATTTGAAATAAAGTTGAATATT
ATATATAA

FIGURE 104

></usr/seqdb2/sst/DNA/Dnaseqs.full/ss.DNA52756
><subunit 1 of 1, 750 aa, 1 stop
><MW: 84305, pI: 6.93, NX(S/T): 10
MWNLLHETDSAVATARRPRWLCAGALVLAGGFFLLGFLFGWFIKSSNEATNITPKHNMKAFLDELKAENIKKFLH
NFTQIPHLAGTEQNFQLAKQIQSQWKEFGLDSVELAHYDVLLSYPNKTHPNYISIINEDGNEIFNTSLFEPPPPG
YENVSDIVPPFSAFSPQGMPEGDLVYVNYARTEDFFKLERDMKINCSGKIVIARYGKVFRGNKVKNAQLAGAKGV
ILYSDPADYFAPGVKSYPDGWNLPGGGVQRGNILNLNGAGDPLTPGYPANEYAYRRGIAEAVGLPSIPVHPIGYY
DAQKLLEKMGGSAPPDSSWRGSLKVPYNVGPGFTGNFSTQKVKMHIHSTNEVTRIYNVIGTLRGAVEPDRYVILG
GHRDSWVFGGIDPQSGAAVVHEIVRSFGTLKKEGWRPRRTILFASWDAEEFGLLGSTEWAEENSRLLQERGVAYI
NADSSIEGNYTLRVDCTPLMYSLVHNLTKELKSPDEGFEGKSLYESWTKKSPSPEFSGMPRISKLGSGNDFEVFF
QRLGIASGRARYTKNWETNKFSGYPLYHSVYETYELVEKFYDPMFKYHLTVAQVRGGMVFELANSIVLPFDCRDY
AVVLRKYADKIYSISMKHPQEMKTYSVSFDSLFSAVKNFTEIASKFSERLQDFDKSNPIVLRMMNDQLMFLERAF
IDPLGLPDRPFYRHVIYAPSSHNKYAGESFPGIYDALFDIESKVDPSKAWGEVKRQIYVAAFTVQAAAETLSEVA

Signal sequence:
amino acids 1-40

N-glycosylation sites.
amino acids 76-80, 121-125, 140-144, 153-157, 195-199, 336-340, 459-463, 476-480, 638-642

Tyrosine kinase phosphorylation sites.
amino acids 363-372, 605-613, 606-613, 617-626

N-myristoylation sites.
amino acids 85-91, 168-174, 252-258, 256-262, 282-288, 335-341, 360-366, 427-433, 529-535, 707-713

FIGURE 105

TGAAGAGTAATAGTTGGAATCAAAAGAGTCAACGCAATGAACTGTTATTTACTGCTGCGTTTTATGTTGGGAATT
CCTCTCCTATGGCCTTGTCTTGGAGCAACAGAAAACTCTCAAACAAAGAAAGTCAAGCAGCCAGTGCGATCTCAT
TTGAGAGTGAAGCGTGGCTGGGTGTGGAACCAATTTTTTGTACCAGAGGAAATGAATACGACTAGTCATCACATC
GGCCAGCTAAGATCTGATTTAGACAATGGAAACAATTCTTTCCAGTACAAGCTTTTGGGAGCTGGAGCTGGAAGT
ACTTTTATCATTGATGAAAGAACAGGTGACATATATGCCATACAGAAGCTTGATAGAGAGGAGCGATCCCTCTAC
ATCTTAAGAGCCCAGGTAATAGACATCGCTACTGGAAGGGCTGTGGAACCTGAGTCTGAGTTTGTCATCAAAGTT
TCGGATATCAATGACAATGAACCAAAATTCCTAGATGAACCTTATGAGGCCATTGTACCAGAGATGTCTCCAGAA
GGAACATTAGTTATCCAGGTGACAGCAAGTGATGCTGACGATCCCTCAAGTGGTAATAATGCTCGTCTCCTCTAC
AGCTTACTTCAAGGCCAGCCATATTTTTCTGTTGAACCAACAACAGGAGTCATAAGAATATCTTCTAAAATGGAT
AGAGAACTGCAAGATGAGTATTGGGTAATCATTCAAGCCAAGGACATGATTGGTCAGCCAGGAGCGTTGTCTGGA
ACAACAAGTGTATTAATTAAACTTTCAGATGTTAATGACAATAAGCCTATATTTAAAGAAAGTTTATACCGCTTG
ACTGTCTCTGAATCTGCACCCACTGGGACTTCTATAGGAACAATCATGGCATATGATAATGACATAGGAGAGAAT
GCAGAAATGGATTACAGCATTGAAGAGGATGATTCGCAAACATTTGACATTATTACTAATCATGAAACTCAAGAA
GGAATAGTTATATTAAAAAAGAAAGTGGATTTTGAGCACCAGAACCACTACGGTATTAGAGCAAAAGTTAAAAAC
CATCATGTTCCTGAGCAGCTCATGAAGTACCACACTGAGGCTTCCACCACTTTCATTAAGATCCAGGTGGAAGAT
GTTGATGAGCCTCCTCTTTTCCTCCTTCCATATTATGTATTTGAAGTTTTTGAAGAAACCCCACAGGGATCATTT
GTAGGCGTGGTGTCTGCCACAGACCCAGACAATAGGAAATCTCCTATCAGGTATTCTATTACTAGGAGCAAAGTG
TTCAATATCAATGATAATGGTACAATCACTACAAGTAACTCACTGGATCGTGAAATCAGTGCTTGGTACAACCTA
AGTATTACAGCCACAGAAAAATACAATATAGAACAGATCTCTTCGATCCCACTGTATGTGCAAGTTCTTAACATC
AATGATCATGCTCCTGAGTTCTCTCAATACTATGAGACTTATGTTTGTGAAAATGCAGGCTCTGGTCAGGTAATT
CAGACTATCAGTGCAGTGGATAGAGATGAATCCATAGAAGAGCACCATTTTTACTTTAATCTATCTGTAGAAGAC
ACTAACAATTCAAGTTTTACAATCATAGATAATCAAGATAACACAGCTGTCATTTTGACTAATAGAACTGGTTTT
AACCTTCAAGAAGAACCTGTCTTCTACATCTCCATCTTAATTGCCGACAATGGAATCCCGTCACTTACAAGTACA
AACACCCTTACCATCCATGTCTGTGACTGTGGTGACAGTGGGAGCACACAGACCTGCCAGTACCAGGAGCTTGTG
CTTTCCATGGGATTCAAGACAGAAGTTATCATTGCTATTCTCATTTGCATTATGATCATATTTGGGTTTATTTTT
TTGACTTTGGGTTTAAAACAACGGAGAAAACAGATTCTATTTCCTGAGAAAAGTGAAGATTTCAGAGAGAATATA
TTCCAATATGATGATGAAGGGGGTGGAGAAGAAGATACAGAGGCCTTTGATATAGCAGAGCTGAGGAGTAGTACC
ATAATGCGGGAACGCAAGACTCGGAAAACCACAAGCGCTGAGATCAGGAGCCTATACAGGCAGTCTTTGCAAGTT
GGCCCCGACAGTGCCATATTCAGGAAATTCATTCTGGAAAAGCTCGAAGAAGCTAATACTGATCCGTGTGCCCCT
CCTTTTGATTCCCTCCAGACCTACGCTTTTGAGGGAACAGGGTCATTAGCTGGATCCCTGAGCTCCTTAGAATCA
GCAGTCTCTGATCAGGATGAAAGCTATGATTACCTTAATGAGTTGGGACCTCGCTTTAAAAGATTAGCATGCATG
TTTGGTTCTGCAGTGCAGTCAAATAATTAGGGCTTTTTACCATCAAAATTTTTAAAAGTGCTAATGTGTATTCGA
ACCCAATGGTAGTCTTAAAGAGTTTTGTGCCCTGGCTCTATGGCGGGGAAAGCCCTAGTCTATGGAGTTTTCTGA
TTTCCCTGGAGTAAATACTCCATGGTTATTTTAAGCTACCTACATGCTGTCATTGAACAGAGATGTGGGGAGAAA
TGTAAACAATCAGCTCACAGGCATCAATACAACCAGATTTGAAGTAAAATAATGTAGGAAGATATTAAAAGTAGA
TGAGAGGACACAAGATGTAGTCGATCCTTATGCGATTATATCATTATTTACTTAGGAAAGAGTAAAAATACCAAA
CGAGAAAATTTAAAGGAGCAAAAATTTGCAAGTCAAATAGAAATGTACAAATCGAGATAACATTTACATTTCTAT
CATATTGACATGAAAATTGAAAATGTATAGTCAGAGAAATTTTCATGAATTATTCCATGAAGTATTGTTTCCTTT
ATTTAAA

FIGURE 106

></usr/seqdb2/sst/DNA/Dnaseqs.min/ss.DNA53906
><subunit 1 of 1, 772 aa, 1 stop
><MW: 87002, pI: 4.64, NX(S/T): 8
MNCYLLLRFMLGIPLLWPCLGATENSQTKKVKQPVRSHLRVKRGWVWNQFFVPEEMNTTSHHIGQLRSDLDNGNN
SFQYKLLGAGAGSTFIIDERTGDIYAIQKLDREERSLYILRAQVIDIATGRAVEPESEFVIKVSDINDNEPKFLD
EPYEAIVPEMSPEGTLVIQVTASDADDPSSGNNARLLYSLLQGQPYFSVEPTTGVIRISSKMDRELQDEYWVIIQ
AKDMIGQPGALSGTTSVLIKLSDVNDNKPIFKESLYRLTVSESAPTGTSIGTIMAYDNDIGENAEMDYSIEEDDS
QTFDIITNHETQEGIVILKKKVDFEHQNHYGIRAKVKNHHVPEQLMKYHTEASTTFIKIQVEDVDEPPLFLLPYY
VFEVFEETPQGSFVGVVSATDPDNRKSPIRYSITRSKVFNINDNGTITTSNSLDREISAWYNLSITATEKYNIEQ
ISSIPLYVQVLNINDHAPEFSQYYETYVCENAGSGQVIQTISAVDRDESIEEHHFYFNLSVEDTNNSSFTIIDNQ
DNTAVILTNRTGFNLQEEPVFYISILIADNGIPSLTSTNTLTIHVCDCGDSGSTQTCQYQELVLSMGFKTEVIIA
ILICIMIIFGFIFLTLGLKQRRKQILFPEKSEDFRENIFQYDDEGGGEEDTEAFDIAELRSSTIMRERKTRKTTS
AEIRSLYRQSLQVGPDSAIFRKFILEKLEEANTDPCAPPFDSLQTYAFEGTGSLAGSLSSLESAVSDQDESYDYL
NELGPRFKRLACMFGSAVQSNN

Important features:
Signal peptide:
amino acids 1-21

Transmembrane domain:
amino acids 597-617

N-glycosylation sites.
amino acids 57-60, 74-77, 419-423, 437-440, 508-511, 515-518, 516-519 and 534-537

Cadherins extracellular repeated domain signature.
amino acids 136-146 and 244-254

FIGURE 107

ATCTGGTTGAACTACTTAAGCTTAATTTGTTAAACTCCGGTAAGTACCTAGCCCACATGATTTGACTCAGAGATT
CTCTTTTGTCCACAGACAGTCATCTCAGGGGCAGAAAGAAAAGAGCTCCCAAATGCTATATCTATTCAGGGGCTC
TCAAGAACAATGGAATATCATCCTGATTTAGAAAATTTGGATGAAGATGGATATACTCAATTACACTTCGACTCT
CAAAGCAATACCAGGATAGCTGTTGTTTCAGAGAAAGGATCGTGTGCTGCATCTCCTCCTTGGCGCCTCATTGCT
GTAATTTTGGGAATCCTATGCTTGGTAATACTGGTGATAGCTGTGGTCCTGGGTACCATGGGGGTTCTTTCCAGC
CCTTGTCCTCCTAATTGGATTATATATGAGAAGAGCTGTTATCTATTCAGCATGTCACTAAATTCCTGGGATGGA
AGTAAAAGACAATGCTGGCAACTGGGCTCTAATCTCCTAAAGATAGACAGCTCAAATGAATTGGGATTTATAGTA
AAACAAGTGTCTTCCCAACCTGATAATTCATTTTGGATAGGCCTTTCTCGGCCCCAGACTGAGGTACCATGGCTC
TGGGAGGATGGATCAACATTCTCTTCTAACTTATTTCAGATCAGAACCACAGCTACCCAAGAAAACCCATCTCCA
AATTGTGTATGGATTCACGTGTCAGTCATTTATGACCAACTGTGTAGTGTGCCCTCATATAGTATTTGTGAGAAG
AAGTTTTCAATGTAAGAGGAAGGGTGGAGAAGGAGAGAGAAATATGTGAGGTAGTAAGGAGGACAGAAAACAGAA
CAGAAAAGAGTAACAGCTGAGGTCAAGATAAATGCAGAAAATGTTTAGAGAGCTTGGCCAACTGTAATCTTAACC
AAGAAATTGAAGGGAGAGGCTGTGATTTCTGTATTTGTCGACCTACAGGTAGGCTAGTATTATTTTTCTAGTTAG
TAGATCCCTAGACATGGAATCAGGGCAGCCAAGCTTGAGTTTTTATTTTTTATTTATTTATTTTTTTGAGATAGG
GTCTCACTTTGTTACCCAGGCTGGAGTGCAGTGGCACAATCTCGACTCACTGCAGCTATCTCTCGCCTCAGCCCC
TCAAGTAGCTGGGACTACAGGTGCATGCCACCATGCCAGGCTAATTTTTGGTGTTTTTTGTAGAGACTGGGTTTT
GCCATGTTGACCAAGCTGGTCTCTAACTCCTGGGCTTAAGTGATCTGCCCGCCTTGGCCTCCCAAAGTGCTGGGA
TTACAGATGTGAGCCACCACACCTGGCCCCAAGCTTGAATTTTCATTCTGCCATTGACTTGGCATTTACCTTGGG
TAAGCCATAAGCGAATCTTAATTTCTGGCTCTATCAGAGTTGTTTCATGCTCAACAATGCCATTGAAGTGCACGG
TGTGTTGCCACGATTTGACCCTCAACTTCTAGCAGTATATCAGTTATGAACTGAGGGTGAAATATATTTCTGAAT
AGCTAAATGAAGAAATGGGAAAAAATCTTCACCACAGTCAGAGCAATTTTATTATTTTCATCAGTATGATCATAA
TTATGATTATCATCTTAGTAAAAAGCAGGAACTCCTACTTTTTCTTTATCAATTAAATAGCTCAGAGAGTACATC
TGCCATATCTCTAATAGAATCTTTTTTTTTTTTTTTTTTTTTTTGAGACAGAGTTTCGCTCTTGTTGCCCAGGCTG
GAGTGCAACGGCACGATCTCGGCTCACCGCAACCTCCGCCCCCTGGGTTCAAGCAATTCTCCTGCCTCAGCCTCC
CAAGTAGCTGGGATTACAGTCAGGCACCACCACACCCGGCTAATTTTGTATTTTTTTAGTAGAGACAGGGTTTCT
CCATGTCGGTCAGGGTAGTCCCGAACTCCTGACCTCAAGTGATCTGCCTGCCTCGGCCTCCCAAGTGCTGGGATT
ACAGGCGTGAGCCACTGCACCCAGCCTAGAATCTTGTATAATATGTAATTGTAGGGAAACTGCTCTCATAGGAAA
GTTTTCTGCTTTTTAAATACAAAAATACATAAAAATACATAAAATCTGATGATGAATATAAAAAAGTAACCAACC
TCATTGGAACAAGTATTAACATTTTGGAATATGTTTTATTAGTTTTGTGATGTACTGTTTTACAATTTTTACCAT
TTTTTTCAGTAATTACTGTAAAATGGTATTATTGGAATGAAACTATATTTCCTCATGTGCTGATTTGTCTTATTT
TTTTCATACTTTCCCACTGGTGCTATTTTTATTTCCAATGGATATTTCTGTATTACTAGGGAGGCATTTACAGTC
CTCTAATGTTGATTAATATGTGAAAAGAAATTGTACCAATTTTACTAAATTATGCAGTTTAAAATGGATGATTTT
ATGTTATGTGGATTTCATTTCAATAAAAAAAAACTCTTATCAAAAAAAAAAAAAAAAAAAAAAAAAAAAAAAAAAA

FIGURE 108

</usr/seqdb2/sst/DNA/Dnaseqs.min/ss.DNA53912
<subunit 1 of 1, 201 aa, 1 stop
<MW: 22563, pI: 4.87, NX(S/T): 1
MEYHPDLENLDEDGYTQLHFDSQSNTRIAVVSEKGSCAASPPWRLIAVILGILCLVILVIAVVLGTMGVLSSPCP
PNWIIYEKSCYLFSMSLNSWDGSKRQCWQLGSNLLKIDSSNELGFIVKQVSSQPDNSFWIGLSRPQTEVPWLWED
GSTFSSNLFQIRTTATQENPSPNCVWIHVSVIYDQLCSVPSYSICEKKFSM

Important features:
Type II transmembrane domain:
amino acids 45-65 cAMP- and cGMP-dependent protein kinase phosphorylation site.
amino acids 197-200

N-myristoylation sites.
amino acids 35-40 and 151-156

Homologous region to LDL receptor
amino acids 34-67 and 70-200.

FIGURE 109

CTGCAAGTTGTTAACGCCTAACACACAAGTATGTTAGGCTTCCACCAAAGTCCTCAATATACCTGAATACGCACA
ATATCTTAACTCTTCATATTTGGTTTTGGGATCTGCTTTGAGGTCCCATCTTCATTTAAAAAAAAATACAGAGAC
CTACCTACCCGTACGCATACATACATATGTGTATATATATGTAAACTAGACAAAGATCGCAGATCATAAAGCAAG
CTCTGCTTTAGTTTCCAAGAAGATTACAAAGAATTTAGAG<u>ATG</u>TATTTGTCAAGATCCCTGTCGATTCATGCCCT
TTGGGTTACGGTGTCCTCAGTGATGCAGCCCTACCCTTTGGTTTGGGGACATTATGATTTGTGTAAGACTCAGAT
TTACACGGAAGAAGGGAAAGTTTGGGATTACATGGCCTGCCAGCCGGAATCCACGGACATGACAAAATATCTGAA
AGTGAAACTCGATCCTCCGGATATTACCTGTGGAGACCCTCCTGAGACGTTCTGTGCAATGGGCAATCCCTACAT
GTGCAATAATGAGTGTGATGCGAGTACCCCTGAGCTGGCACACCCCCCTGAGCTGATGTTTGATTTTGAAGGAAG
ACATCCCTCCACATTTTGGCAGTCTGCCACTTGGAAGGAGTATCCCAAGCCTCTCCAGGTTAACATCACTCTGTC
TTGGAGCAAAACCATTGAGCTAACAGACAACATAGTTATTACCTTTGAATCTGGGCGTCCAGACCAAATGATCCT
GGAGAAGTCTCTCGATTATGGACGAACATGGCAGCCCTATCAGTATTATGCCACAGACTGCTTAGATGCTTTTCA
CATGGATCCTAAATCCGTGAAGGATTTATCACAGCATACGGTCTTAGAAATCATTTGCACAGAAGAGTACTCAAC
AGGGTATACAACAAATAGCAAAATAATCCACTTTGAAATCAAAGACAGGTTCGCGCTTTTTGCTGGACCTCGCCT
ACGCAATATGGCTTCCCTCTACGGACAGCTGGATACAACCAAGAAACTCAGAGATTTCTTTACAGTCACAGACCT
GAGGATAAGGCTGTTAAGACCAGCCGTTGGGGAAATATTTGTAGATGAGCTACACTTGGCACGCTACTTTTACGC
GATCTCAGACATAAAGGTGCGAGGAAGGTGCAAGTGTAATCTCCATGCCACTGTATGTGTGTATGACAACAGCAA
ATTGACATGCGAATGTGAGCACAACACTACAGGTCCAGACTGTGGGAAATGCAAGAAGAATTATCAGGGCCGACC
TTGGAGTCCAGGCTCCTATCTCCCCATCCCCAAAGGCACTGCAAATACCTGTATCCCCAGTATTTCCAGTATTGG
TACGAATGTCTGCGACAACGAGCTCCTGCACTGCCAGAACGGAGGGACGTGCCACAACAACGTGCGCTGCCTGTG
CCCGGCCGCATACACGGGCATCCTCTGCGAGAAGCTGCGGTGCGAGGAGGCTGGCAGCTGCGGCTCCGACTCTGG
CCAGGGCGCGCCCCCGCACGGCACCCCAGCGCTGCTGCTGCTGACCACGCTGCTGGGAACCGCCAGCCCCCTGGT
GTTC<u>TAG</u>GTGTCACCTCCAGCCACACCGGACGGGCCTGTGCCGTGGGGAAGCAGACACAACCCAAACATTTGCTA
CTAACATAGGAAACACACACATACAGACACCCCCACTCAGACAGTGTACAAACTAAGAAGGCCTAACTGAACTAA
GCCATATTTATCACCCGTGGACAGCACATCCGAGTCAAGACTGTTAATTTCTGACTCCAGAGGAGTTGGCAGCTG
TTGATATTATCACTGCAAATCACATTGCCAGCTGCAGAGCATATTGTGGATTGGAAAGGCTGCGACAGCCCCCCA
AACAGGAAAGACAAAAAACAAACAAATCAACCGACCTAAAAACATTGGCTACTCTAGCGTGGTGCGCCCTAGTAC
GACTCCGCCCAGTGTGTGGACCAACCAAATAGCATTCTTTGCTGTCAGGTGCATTGTGGGCATAAGGAAATCTGT
TACAAGCTGCCATATTGGCCTGCTTCCGTCCCTGAATCCCTTCCAACCTGTGCTTTAGTGAACGTTGCTCTGTAA
CCCTCGTTGGTTGAAAGATTTCTTTGTCTGATGTTAGTGATGCACATGTGTAACAGCCCCCTCTAAAAGCGCAAG
CCAGTCATACCCCTGTATATCTTAGCAGCACTGAGTCCAGTGCGAGCACACACCCACTATACAAGAGTGGCTATA
GGAAAAAAGAAAGTGTATCTATCCTTTTGTATTCAAATGAAGTTATTTTTCTTGAACTACTGTAATATGTAGATT
TTTTGTATTATTGCCAATTTGTGTTACCAGACAATCTGTTAATGTATCTAATTCGAATCAGCAAAGACTGACATT
TTATTTTGTCCTCTTTCGTTCTGTTTTGTTTCACTGTGCAGAGATTTCTCTGTAAGGGCAACGAACGTGCTGGCA
TCAAAGAATATCAGTTTACATATATAACAAGTGTAATAAGATTCCACCAAAGGACATTCTAAATGTTTTCTTGTT
GCTTTAACACTGGAAGATTTAAAGAATAAAAACTCCTGCATAAACGATTTCAGGAATTTGTATTGCAATTTCTTA
AGATGAAAGGAACAGCCACCAAGCAGTTTCACACTCACTTTACTGATTTCTGTGTGGACTGAGTACATTCAGCTG
ACGAATTTAGTTCCCAGGAAGATGGATTGATGTTCACTAGCTTGGACAACTTCTGCAAAATATGAGACTATTTCC
ACTTGGGAAAAATTACAACAGCAAAAAAAAAAAAAAAAAAAAA

FIGURE 110

MYLSRSLSIHALWVTVSSVMQPYPLVWGHYDLCKTQIYTEEGKVWDYMACQPESTDMTKYLKVKLDPPDITCGDP
PETFCAMGNPYMCNNECDASTPELAHPPELMFDFEGRHPSTFWQSATWKEYPKPLQVNITLSWSKTIELTDNIVI
TFESGRPDQMILEKSLDYGRTWQPYQYYATDCLDAFHMDPKSVKDLSQHTVLEIICTEEYSTGYTTNSKIIHFEI
KDRFALFAGPRLRNMASLYGQLDTTKKLRDFFTVTDLRIRLLRPAVGEIFVDELHLARYFYAISDIKVRGRCKCN
LHATVCVYDNSKLTCECEHNTTGPDCGKCKKNYQGRPWSPGSYLPIPKGTANTCIPSISSIGTNVCDNELLHCQN
GGTCHNNVRCLCPAAYTGILCEKLRCEEAGSCGSDSGQGAPPHGTPALLLLTTLLGTASPLVF

FIGURE 111

GCGTGCCGTCAGCTCGCCGGGCACCGCGGCCTCGCCCTCGCCCTCCGCCCCTGCGCCTGCACCGCGTAGACCGAC
CCCCCCCTCCAGCGCGCCCACCCGGTAGAGGACCCCCGCCCGTGCCCCGACCGGTCCCCGCCTTTTTGTAAAACT
TAAAGCGGGCGCAGCATTAACGCTTCCCGCCCCGGTGACCTCTCAGGGGTCTCCCCGCCAAAGGTGCTCCGCCGC
TAAGGAACATGGCGAAGGTGGAGCAGGTCCTGAGCCTCGAGCCGCAGCACGAGCTCAAATTCCGAGGTCCCTTCA
CCGATGTTGTCACCACCAACCTAAAGCTTGGCAACCCGACAGACCGAAATGTGTGTTTTAAGGTGAAGACTACAG
CACCACGTAGGTACTGTGTGAGGCCCAACAGCGGAATCATCGATGCAGGGGCCTCAATTAATGTATCTGTGATGT
TACAGCCTTTCGATTATGATCCCAATGAGAAAAGTAAACACAAGTTTATGGTTCAGTCTATGTTTGCTCCAACTG
ACACTTCAGATATGGAAGCAGTATGGAAGGAGGCAAAACCGGAAGACCTTATGGATTCAAAACTTAGATGTGTGT
TTGAATTGCCAGCAGAGAATGATAAACCACATGATGTAGAAATAAATAAAATTATATCCACAACTGCATCAAAGA
CAGAAACACCAATAGTGTCTAAGTCTCTGAGTTCTTCTTTGGATGACACCGAAGTTAAGAAGGTTATGGAAGAAT
GTAAGAGGCTGCAAGGTGAAGTTCAGAGGCTACGGGAGGAGAACAAGCAGTTCAAGGAAGAAGATGGACTGCGGA
TGAGGAAGACAGTGCAGAGCAACAGCCCCATTTCAGCATTAGCCCCAACTGGGAAGGAAGAAGGCCTTAGCACCC
GGCTCTTGGCTCTGGTGGTTTTGTTCTTTATCGTTGGTGTAATTATTGGGAAGATTGCCTTGTAGAGGTAGCATG
CACAGGATGGTAAATTGGATTGGTGGATCCACCATATCATGGGATTTAAATTTATCATAACCATGTGTAAAAAGA
AATTAATGTATGATGACATCTCACAGGTCTTGCCTTTAAATTACCCCTCCCTGCACACACATACACAGATACACA
CACACAAATATAATGTAACGATCTTTTAGAAAGTTAAAAATGTATAGTAACTGATTGAGGGGGAAAAAGAATGAT
CTTTATTAATGACAAGGGAAACCATGAGTAATGCCACAATGGCATATTGTAAATGTCATTTTAAACATTGGTAGG
CCTTGGTACATGATGCTGGATTACCTCTCTTAAAATGACACCCTTCCTCGCCTGTTGGTGCTGGCCCTTGGGGAG
CTGGAGCCCAGCATGCTGGGGAGTGCGGTCAGCTCCACACAGTAGTCCCCACGTGGCCCACTCCCGGCCCAGGCT
GCTTTCCGTGTCTTCAGTTCTGTCCAAGCCATCAGCTCCTTGGGACTGATGAACAGAGTCAGAAGCCCAAAGGAA
TTGCACTGTGGCAGCATCAGACGTACTCGTCATAAGTGAGAGGCGTGTGTTGACTGATTGACCCAGCGCTTTGGA
AATAAATGGCAGTGCTTTGTTCACTTAAAGGGACCAAGCTAAATTTGTATTGGTTCATGTAGTGAAGTCAAACTG
TTATTCAGAGATGTTTAATGCATATTTAACTTATTTAATGTATTTCATCTCATGTTTTCTTATTGTCACAAGAGT
ACAGTTAATGCTGCGTGCTGCTGAACTCTGTTGGGTGAACTGGTATTGCTGCTGGAGGGCTGTGGCTCCTCTGT
CTCTGGAGAGTCTGGTCATGTGGAGGTGGGGTTTATTGGGATGCTGGAGAAGAGCTGCCAGGAAGTGTTTTTTCT
GGGTCAGTAAATAACAACTGTCATAGGGAGGGAAATTCTCAGTAGTGACAGTCAACTCTAGGTTACCTTTTTTAA
TGAAGAGTAGTCAGTCTTCTAGATTGTTCTTATACCACCTCTCAACCATTACTCACACTTCCAGCGCCCAGGTCC
AAGTCTGAGCCTGACCTCCCCTTGGGGACCTAGCCTGGAGTCAGGACAAATGGATCGGGCTGCAGAGGGTTAGAA
GCGAGGGCACCAGCAGTTGTGGGTGGGGAGCAAGGGAAGAGAGAAACTCTTCAGCGAATCCTTCTAGTACTAGTT
GAGAGTTTGACTGTGAATTAATTTTATGCCATAAAAGACCAACCCAGTTCTGTTTGACTATGTAGCATCTTGAAA
AGAAAAATTATAATAAAGCCCCAAAATTAAGAAAA

FIGURE 112

</usr/seqdb2/sst/DNA/Dnaseqs.min/ss.DNA53977
<subunit 1 of 1, 243 aa, 1 stop
<MW: 27228, pI: 7.43, NX(S/T): 2
MAKVEQVLSLEPQHELKFRGPFTDVVTTNLKLGNPTDRNVCFKVKTTAPRRYCVRPNSGIIDAGASINVSVMLQP
FDYDPNEKSKHKFMVQSMFAPTDTSDMEAVWKEAKPEDLMDSKLRCVFELPAENDKPHDVEINKIISTTASKTET
PIVSKSLSSSLDDTEVKKVMEECKRLQGEVQRLREENKQFKEEDGLRMRKTVQSNSPISALAPTGKEEGLSTRLL
ALVVLFFIVGVIIGKIAL

Important features:
Transmembrane domain:
amino acids 224-239

N-glycosylation site.
amino acids 68-71

N-myristoylation site.
amino acids 59-64, 64-69 and 235-240

FIGURE 113

CCCACGCGTCCGGGTGACCTGGGCCGAGCCCTCCCGGTCGGCTAAGATTGCTGAGGAGGCGGCGGGTAGCTGGCA
GGCGCCGACTTCCGAAGGCCGCCGTCCGGGCGAGGTGTCCTCATGACTTCTCTTGTGGACCATGTCCGTGATCTT
TTTTGCCTGCGTGGTACGGGTAAGGGATGGACTGCCCCTCTCAGCCTCTACTGATTTTTACCACACCCAAGATTT
TTTGGAATGGAGGAGACGGCTCAAGAGTTTAGCCTTGCGACTGGCCCAGTATCCAGGTCGAGGTTCTGCAGAAGG
TTGTGACTTTAGTATACATTTTTCTTCTTTCGGGGACGTGGCCTGCATGGCTATCTGCTCCTGCCAGTGTCCAGC
AGCCATGGCCTTCTGCTTCCTGGAGACCCTGTGGTGGGAATTCACAGCTTCCTATGACACTACCTGCATTGGCCT
AGCCTCCAGGCCATACGCTTTTCTTGAGTTTGACAGCATCATTCAGAAAGTGAAGTGGCATTTTAACTATGTAAG
TTCCTCTCAGATGGAGTGCAGCTTGGAAAAAATTCAGGAGGAGCTCAAGTTGCAGCCTCCAGCGGTTCTCACTCT
GGAGGACACAGATGTGGCAAATGGGGTGATGAATGGTCACACACCGATGCACTTGGAGCCTGCTCCTAATTTCCG
AATGGAACCAGTGACAGCCCTGGGTATCCTCTCCCTCATTCTCAACATCATGTGTGCTGCCCTGAATCTCATTCG
AGGAGTTCACCTTGCAGAACATTCTTTACAGGATCCAAGGAGCTGGTTCTGCTGGTTGGACCAAACCTCGTGAGC
CAGCCACCCCTGACCCAAATGAGGAGAGCTCTGATTCTCCCATCCGGGAGCAGTGATGTCAAACTTCTGCTGCTG
GGGAAATCTCATCAGCAGGGAGCCTGTGGAAAAGGGCATGTCAGTGAAATCTGGGAATGGCTGGATTCGGAAACA
TCTGCCCATGTGTATTGATGGCAGAGCTGTTGCCCACAAGCGCCTTTTATTTAGGGTAAAATTAACAAATCCATT
CTATTCCTCTGACCCATGCTTAGTACATATGACCTTTAACCCTTACATTTATATGATTCTGGGGTTGCTTCAGAA
GTGTTATTTCATGAATCATTCATATGATTTGATCCCCCAGGATTCTATTTTGTTTAATGGGCTTTTCTACTAAAA
GCATAAAATACTGAGGCTGATTTAGTCAGGGCAAAACCATTTACTTTACATATTCGTTTTCAATACTTGCTGTTC
ATGTTACACAAGCTTCTTACGGTTTTCTTGTAACAATAAATATTTTGAGTAAATAATGGGTACATTTTAACAAAC
TCAGTAGTACAACCTAAACTTGTATAAAAGTGTGTAAAAATGTATAGCCATTTATATCCTATGTATAAATTAAAT
GAGGTGGCTTCAGAAATGGCAGAATAAATCTAAAGTGTTTATTAAAAAAAAAAAAAAAAAAAAAAAAG

FIGURE 114

MSVIFFACVVRVRDGLPLSASTDFYHTQDFLEWRRRLKSLALRLAQYPGRGSAEGCDFSIHFSSFGDVACMAICS
CQCPAAMAFCFLETLWWEFTASYDTTCIGLASRPYAFLEFDSIIQKVKWHFNYVSSSQMECSLEKIQEELKLQPP
AVLTLEDTDVANGVMNGHTPMHLEPAPNFRMEPVTALGILSLILNIMCAALNLIRGVHLAEHSLQDPRSWFCWLDQTS

FIGURE 115

```
CTCAGCGGCGCTTCCTCGTAGCGAGCCTAGTGGCGGGTGTTTGCATTGAAACGTGAGCGCGACCCGACCTTAAAG
AGTGGGGAGCAAAGGGAGGACAGAGCCCTTTAAAACGAGGCGGGTGGTGCCTGCCCCTTTAAGGGCGGGGCGTCC
GGACGACTGTATCTGAGCCCCAGACTGCCCCGAGTTTCTGTCGCAGGCTGCGAGGAAAGGCCCCTAGGCTGGGTC
TGGGTGCTTGGCGGCGGCGGCTTCCTCCCCGCTCGTCCTCCCCGGGCCCAGAGGCACCTCGGCTTCAGTCATGCT
GAGCAGAGTATGGAAGCACCTGACTACGAAGTGCTATCCGTGCGAGAACAGCTATTCCACGAGAGGATCCGCGAG
TGTATTATATCAACACTTCTGTTTGCAACACTGTACATCCTCTGCCACATCTTCCTGACCCGCTTCAAGAAGCCT
GCTGAGTTCACCACAGTGGATGATGAAGATGCCACCGTCAACAAGATTGCGCTCGAGCTGTGCACCTTTACCCTG
GCAATTGCCCTGGGTGCTGTCCTGCTCCTGCCCTTCTCCATCATCAGCAATGAGGTGCTGCTCTCCCTGCCTCGG
AACTACTACATCCAGTGGCTCAACGGCTCCCTCATCCATGGCCTCTGGAACCTTGTTTTTCTCTTCCCCAACCTG
TCCCTCATCTTCCTCATGCCCTTTGCATATTTCTTCACTGAGTCTGAGGGCTTTGCTGGCTCCAGAAAGGGTGTC
CTGGGCCGGGTCTATGAGACAGTGGTGATGTTGATGCTCCTCACTCTGCTGGTGCTAGGTATGGTGTGGGTGGCA
TCAGCCATTGTGGACAAGAACAAGGCCAACAGAGAGTCACTCTATGACTTTTGGGAGTACTATCTCCCCTACCTC
TACTCATGCATCTCCTTCCTTGGGGTTCTGCTGCTCCTGGTGTGTACTCCACTGGGTCTCGCCCGCATGTTCTCC
GTCACTGGGAAGCTGCTAGTCAAGCCCCGGCTGCTGGAAGACCTGGAGGAGCAGCTGTACTGCTCAGCCTTTGAG
GAGGCAGCCCTGACCCGCAGGATCTGTAATCCTACTTCCTGCTGGCTGCCTTTAGACATGGAGCTGCTACACAGA
CAGGTCCTGGCTCTGCAGACACAGAGGGTCCTGCTGGAGAAGAGGCGGAAGGCTTCAGCCTGGCAACGGAACCTG
GGCTACCCCCTGGCTATGCTGTGCTTGCTGGTGCTGACGGGCCTGTCTGTGCTCATTGTGGCCATCCACATCCTG
GAGCTGCTCATCGATGAGGCTGCCATGCCCCGAGGCATGCAGGGTACCTCCTTAGGCCAGGTCTCCTTCTCCAAG
CTGGGCTCCTTTGGTGCCGTCATTCAGGTTGTACTCATCTTTTACCTAATGGTGTCCTCAGTTGTGGGCTTCTAT
AGCTCTCCACTCTTCCGGAGCCTGCGGCCCAGATGGCACGACACTGCCATGACGCAGATAATTGGGAACTGTGTC
TGTCTCCTGGTCCTAAGCTCAGCACTTCCTGTCTTCTCTCGAACCCTGGGGCTCACTCGCTTTGACCTGCTGGGT
GACTTTGGACGCTTCAACTGGCTGGGCAATTTCTACATTGTGTTCCTCTACAACGCAGCCTTTGCAGGCCTCACC
ACACTCTGTCTGGTGAAGACCTTCACTGCAGCTGTGCGGGCAGAGCTGATCCGGGCCTTTGGGCTGGACAGACTG
CCGCTGCCCGTCTCCGGTTTCCCCCAGGCATCTAGGAAGACCCAGCACCAGTGACCTCCAGCTGGGGGTGGGAAG
GAAAAAACTGGACACTGCCATCTGCTGCCTAGGCCTGGAGGGAAGCCCAAGGCTACTTGGACCTCAGGACCTGGA
ATCTGAGAGGGTGGGTGGCAGAGGGGAGCAGAGCCATCTGCACTATTGCATAATCTGAGCCAGAGTTTGGGACCA
GGACCTCCTGCTTTTCCATACTTAACTGTGGCCTCAGCATGGGGTAGGGCTGGGTGACTGGGTCTAGCCCCTGAT
CCCAAATCTGTTTACACATCAATCTGCCTCACTGCTGTTCTGGGCCATCCCCATAGCCATGTTTACATGATTTGA
TGTGCAATAGGGTGGGGTAGGGGCAGGGAAAGGACTGGGCCAGGGCAGGCTCGGGAGATAGATTGTCTCCCTTGC
CTCTGGCCCAGCAGAGCCTAAGCACTGTGCTATCCTGGAGGGGCTTTGGACCACCTGAAAGACCAAGGGGATAGG
GAGGAGGAGGCTTCAGCCATCAGCAATAAAGTTGATCCCAGGGAAAAAAA
```

FIGURE 116

MEAPDYEVLSVREQLFHERIRECIISTLLFATLYILCHIFLTRFKKPAEFTTVDDEDATVNKIALELCTFTLAIA
LGAVLLLPFSIISNEVLLSLPRNYYIQWLNGSLIHGLWNLVFLFPNLSLIFLMPFAYFFTESEGFAGSRKGVLGR
VYETVVMLMLLTLLVLGMVWVASAIVDKNKANRESLYDFWEYYLPYLYSCISFLGVLLLLVCTPLGLARMFSVTG
KLLVKPRLLEDLEEQLYCSAFEEAALTRRICNPTSCWLPLDMELLHRQVLALQTQRVLLEKRRKASAWQRNLGYP
LAMLCLLVLTGLSVLIVAIHILELLIDEAAMPRGMQGTSLGQVSFSKLGSFGAVIQVVLIFYLMVSSVVGFYSSP
LFRSLRPRWHDTAMTQIIGNCVCLLVLSSALPVFSRTLGLTRFDLLGDFGRFNWLGNFYIVFLYNAAFAGLTTLC
LVKTFTAAVRAELIRAFGLDRLPLPVSGFPQASRKTQHQ

FIGURE 117

GAGAACAGGCCTGTCTCAGGCAGGCCCTGCGCCTCCTATGCGGAGATGCTACTGCCACTGCTGCTGTCCTCGCTG
CTGGGCGGGTCCCAGGCTATGGATGGGAGATTCTGGATACGAGTGCAGGAGTCAGTGATGGTGCCGGAGGGCCTG
TGCATCTCTGTGCCCTGCTCTTTCTCCTACCCCCGACAAGACTGGACAGGGTCTACCCCAGCTTATGGCTACTGG
TTCAAAGCAGTGACTGAGACAACCAAGGGTGCTCCTGTGGCCACAAACCACCAGAGTCGAGAGGTGGAAATGAGC
ACCCGGGGCCGATTCCAGCTCACTGGGGATCCCGCCAAGGGGAACTGCTCCTTGGTGATCAGAGACGCGCAGATG
CAGGATGAGTCACAGTACTTCTTTCGGGTGGAGAGAGGAAGCTATGTGACATATAATTTCATGAACGATGGGTTC
TTTCTAAAAGTAACAGTGCTCAGCTTCACGCCCAGACCCCAGGACCACAACACCGACCTCACCTGCCATGTGGAC
TTCTCCAGAAAGGGTGTGAGCGCACAGAGGACCGTCCGACTCCGTGTGGCCTATGCCCCCAGAGACCTTGTTATC
AGCATTTCACGTGACAACACGCCAGCCCTGGAGCCCCAGCCCCAGGGAAATGTCCCATACCTGGAAGCCCAAAAA
GGCCAGTTCCTGCGGCTCCTCTGTGCTGCTGACAGCCAGCCCCCTGCCACACTGAGCTGGGTCCTGCAGAACAGA
GTCCTCTCCTCGTCCCATCCCTGGGGCCCTAGACCCCTGGGGCTGGAGCTGCCCGGGGTGAAGGCTGGGGATTCA
GGGCGCTACACCTGCCGAGCGGAGAACAGGCTTGGCTCCCAGCAGCGAGCCCTGGACCTCTCTGTGCAGTATCCT
CCAGAGAACCTGAGAGTGATGGTTTCCCAAGCAAACAGGACAGTCCTGGAAAACCTTGGGAACGGCACGTCTCTC
CCAGTACTGGAGGGCCAAAGCCTGTGCCTGGTCTGTGTCACACACAGCAGCCCCCCAGCCAGGCTGAGCTGGACC
CAGAGGGGACAGGTTCTGAGCCCCTCCCAGCCCTCAGACCCCGGGGTCCTGGAGCTGCCTCGGGTTCAAGTGGAG
CACGAAGGAGAGTTCACCTGCCACGCTCGGCACCCACTGGGCTCCCAGCACGTCTCTCTCAGCCTCTCCGTGCAC
TATAAGAAGGGACTCATCTCAACGGCATTCTCCAACGGAGCGTTTCTGGGAATCGGCATCACGGCTCTTCTTTTC
CTCTGCCTGGCCCTGATCATCATGAAGATTCTACCGAAGAGACGGACTCAGACAGAAACCCCGAGGCCCAGGTTC
TCCCGGCACAGCACGATCCTGGATTACATCAATGTGGTCCCGACGGCTGGCCCCCTGGCTCAGAAGCGGAATCAG
AAAGCCACACCAAACAGTCCTCGGACCCCTCCTCCACCAGGTGCTCCCTCCCCAGAATCAAAGAAGAACCAGAAA
AAGCAGTATCAGTTGCCCAGTTTCCCAGAACCCAAATCATCCACTCAAGCCCCAGAATCCCAGGAGAGCCAAGAG
GAGCTCCATTATGCCACGCTCAACTTCCCAGGCGTCAGACCCAGGCCTGAGGCCCGGATGCCCAAGGGCACCCAG
GCGGATTATGCAGAAGTCAAGTTCCAATGAGGGTCTCTTAGGCTTTAGGACTGGGACTTCGGCTAGGGAGGAAGG
TAGAGTAAGAGGTTGAAGATAACAGAGTGCAAAGTTTCCTTCTCTCCCTCTCTCTCTCTCTTTCTCTCTCTCTCT
CTCTTTCTCTCTCTTTTAAAAAAACATCTGGCCAGGGCACAGTGGCTCACGCCTGTAATCCCAGCACTTTGGGAG
GTTGAGGTGGGCAGATCGCCTGAGGTCGGGAGTTCGAGACCAGCCTGGCCAACTTGGTGAAACCCCGTCTCTACT
AAAAATACAAAAATTAGCTGGGCATGGTGGCAGGCGCCTGTAATCCTACCTACTTGGGAAGCTGAGGCAGGAGAA
TCACTTGAACCTGGGAGACGGAGGTTGCAGTGAGCCAAGATCACACCATTGCACGCCAGCCTGGGCAACAAAGCG
AGACTCCATCTCAAAAAAAAAATCCTCCAAATGGGTTGGGTGTCTGTAATCCCAGCACTTTGGGAGGCTAAGGTG
GGTGGATTGCTTGAGCCCAGGAGTTCGAGACCAGCCTGGGCAACATGGTGAAACCCCATCTCTACAAAAAATACA
AAACATAGCTGGGCTTGGTGGTGTGTGCCTGTAGTCCCAGCTGTCAGACATTTAAACCAGAGCAACTCCATCTGG
AATAGGAGCTGAATAAAATGAGGCTGAGACCTACTGGGCTGCATTCTCAGACAGTGGAGGCATTCTAAGTCACAG
GATGAGACAGGAGGTCCGTACAAGATACAGGTCATAAAGACTTTGCTGATAAAACAGATTGCAGTAAAGAAGCCA
ACCAAATCCCACCAAAACCAAGTTGGCCACGAGAGTGACCTCTGGTCGTCCTCACTGCTACACTCCTGACAGCAC
CATGACAGTTTACAAATGCCATGGCAACATCAGGAAGTTACCCGATATGTCCCAAAAGGGGGAGGAATGAATAAT
CCACCCCTTGTTTAGCAAATAAGCAAGAAATAACCATAAAAGTGGGCAACCAGCAGCTCTAGGCGCTGCTCTTGT
CTATGGAGTAGCCATTCTTTTGTTCCTTTACTTTCTTAATAAACTTGCTTTCACCTTAAAAAAA

FIGURE 118

></usr/seqdb2/sst/DNA/Dnaseqs.min/ss.DNA54002
><subunit 1 of 1, 544 aa, 1 stop
><MW: 60268, pI: 9.53, NX(S/T): 3
MLLPLLLSSLLGGSQAMDGRFWIRVQESVMVPEGLCISVPCSFSYPRQDWTGSTPAYGYWFKAVTETTKGAPVAT
NHQSREVEMSTRGRFQLTGDPAKGNCSLVIRDAQMQDESQYFFRVERGSYVTYNFMNDGFFLKVTVLSFTPRPQD
HNTDLTCHVDFSRKGVSAQRTVRLRVAYAPRDLVISISRDNTPALEPQPQGNVPYLEAQKGQFLRLLCAADSQPP
ATLSWVLQNRVLSSSHPWGPRPLGLELPGVKAGDSGRYTCRAENRLGSQQRALDLSVQYPPENLRVMVSQANRTV
LENLGNGTSLPVLEGQSLCLVCVTHSSPPARLSWTQRGQVLSPSQPSDPGVLELPRVQVEHEGEFTCHARHPLGS
QHVSLSLSVHYKKGLISTAFSNGAFLGIGITALLFLCLALIIMKILPKRRTQTETPRPRFSRHSTILDYINVVPT
AGPLAQKRNQKATPNSPRTPPPPGAPSPESKKNQKKQYQLPSFPEPKSSTQAPESQESQEELHYATLNFPGVRPR
PEARMPKGTQADYAEVKFQ

Important features:
Signal peptide:
amino acids 1-15

Transmembrane domain:
amino acids 399-418

N-glycosylation site.
amino acids 100-103, 297-300 and 306-309

Immunoglobulins and major histocompatibility complex proteins signature.
amino acids 365-371

FIGURE 119

CTCGCGCAGGGATCGTCCCATGGCCGGGGCTCGGAGCCGCGACCCTTGGGGGGCCTCCGGGATTTGCTACCTTTT
TGGCTCCCTGCTCGTCGAACTGCTCTTCTCACGGGCTGTCGCCTTCAATCTGGACGTGATGGGTGCCTTGCGCAA
GGAGGGCGAGCCAGGCAGCCTCTTCGGCTTCTCTGTGGCCCTGCACCGGCAGTTGCAGCCCCGACCCCAGAGCTG
GCTGCTGGTGGGTGCTCCCCAGGCCCTGGCTCTTCCTGGGCAGCAGGCGAATCGCACTGGAGGCCTCTTCGCTTG
CCCGTTGAGCCTGGAGGAGACTGACTGCTACAGAGTGGACATCGACCAGGGAGCTGATATGCAAAAGGAAAGCAA
GGAGAACCAGTGGTTGGGAGTCAGTGTTCGGAGCCAGGGGCCTGGGGGCAAGATTGTTACCTGTGCACACCGATA
TGAGGCAAGGCAGCGAGTGGACCAGATCCTGGAGACGCGGGATATGATTGGTCGCTGCTTTGTGCTCAGCCAGGA
CCTGGCCATCCGGGATGAGTTGGATGGTGGGGAATGGAAGTTCTGTGAGGGACGCCCCCAAGGCCATGAACAATT
TGGGTTCTGCCAGCAGGGCACAGCTGCCGCCTTCTCCCCTGATAGCCACTACCTCCTCTTTGGGGCCCCAGGAAC
CTATAATTGGAAGGGCACGGCCAGGGTGGAGCTCTGTGCACAGGGCTCAGCGGACCTGGCACACCTGGACGACGG
TCCCTACGAGGCGGGGGGAGAGAAGGAGCAGGACCCCCGCCTCATCCCGGTCCCTGCCAACAGCTACTTTGGCTT
CTCTATTGACTCGGGGAAAGGTCTGGTGCGTGCAGAAGAGCTGAGCTTTGTGGCTGGAGCCCCCCGCGCCAACCA
CAAGGGTGCTGTGGTCATCCTGCGCAAGGACAGCGCCAGTCGCCTGGTGCCCGAGGTTATGCTGTCTGGGGAGCG
CCTGACCTCCGGCTTTGGCTACTCACTGGCTGTGGCTGACCTCAACAGTGATGGCTGGCCAGACCTGATAGTGGG
TGCCCCCTACTTCTTTGAGCGCCAAGAAGAGCTGGGGGGTGCTGTGTATGTGTACTTGAACCAGGGGGGTCACTG
GGCTGGGATCTCCCCTCTCCGGCTCTGCGGCTCCCCTGACTCCATGTTCGGGATCAGCCTGGCTGTCCTGGGGGA
CCTCAACCAAGATGGCTTTCCAGATATTGCAGTGGGTGCCCCCTTTGATGGTGATGGGAAAGTCTTCATCTACCA
TGGGAGCAGCCTGGGGGTTGTCGCCAAACCTTCACAGGTGCTGGAGGGCGAGGCTGTGGGCATCAAGAGCTTCGG
CTACTCCCTGTCAGGCAGCTTGGATATGGATGGGAACCAATACCCTGACCTGCTGGTGGGCTCCCTGGCTGACAC
CGCAGTGCTCTTCAGGGCCAGACCCATCCTCCATGTCTCCCATGAGGTCTCTATTGCTCCACGAAGCATCGACCT
GGAGCAGCCCAACTGTGCTGGCGGCCACTCGGTCTGTGTGGACCTAAGGGTCTGTTTCAGCTACATTGCAGTCCC
CAGCAGCTATAGCCCTACTGTGGCCCTGGACTATGTGTTAGATGCGGACACAGACCGGAGGCTCCGGGGCCAGGT
TCCCCGTGTGACGTTCCTGAGCCGTAACCTGGAAGAACCCAAGCACCAGGCCTCGGGCACCGTGTGGCTGAAGCA
CCAGCATGACCGAGTCTGTGGAGACGCCATGTTCCAGCTCCAGGAAAATGTCAAAGACAAGCTTCGGGCCATTGT
AGTGACCTTGTCCTACAGTCTCCAGACCCCTCGGCTCCGGCGACAGGCTCCTGGCCAGGGGCTGCCTCCAGTGGC
CCCCATCCTCAATGCCCACCAGCCCAGCACCCAGCGGGCAGAGATCCACTTCCTGAAGCAAGGCTGTGGTGAAGA
CAAGATCTGCCAGAGCAATCTGCAGCTGGTCCACGCCCGCTTCTGTACCCGGGTCAGCGACACGGAATTCCAACC
TCTGCCCATGGATGTGGATGGAACAACAGCCCTGTTTGCACTGAGTGGGCAGCCAGTCATTGGCCTGGAGCTGAT
GGTCACCAACCTGCCATCGGACCCAGCCCAGCCCCAGGCTGATGGGGATGATGCCCATGAAGCCCAGCTCCTGGT
CATGCTTCCTGACTCACTGCACTACTCAGGGGTCCGGGCCCTGGACCCTGCGGAGAAGCCACTCTGCCTGTCCAA
TGAGAATGCCTCCCATGTTGAGTGTGAGCTGGGGAACCCCATGAAGAGAGGTGCCCAGGTCACCTTCTACCTCAT
CCTTAGCACCTCCGGGATCAGCATTGAGACCACGGAACTGGAGGTAGAGCTGCTGTTGGCCACGATCAGTGAGCA
GGAGCTGCATCCAGTCTCTGCACGAGCCCGTGTCTTCATTGAGCTGCCACTGTCCATTGCAGGAATGGCCATTCC
CCAGCAACTCTTCTTCTCTGGTGTGGTGAGGGGCGAGAGAGCCATGCAGTCTGAGCGGGATGTGGGCAGCAAGGT
CAAGTATGAGGTCACGGTTTCCAACCAAGGCCAGTCGCTCAGAACCCTGGGCTCTGCCTTCCTCAACATCATGTG
GCCTCATGAGATTGCCAATGGGAAGTGGTTGCTGTACCCAATGCAGGTTGAGCTGGAGGGCGGGCAGGGGCCTGG
GCAGAAAGGGCTTTGCTCTCCCAGGCCCAACATCCTCCACCTGGATGTGGACAGTAGGGATAGGAGGCGGCGGGA
GCTGGAGCCACCTGAGCAGCAGGAGCCTGGTGAGCGGCAGGAGCCCAGCATGTCCTGGTGGCCAGTGTCCTCTGC
TGAGAAGAAGAAAAACATCACCCTGGACTGCGCCCGGGGCACGGCCAACTGTGTGGTGTTCAGCTGCCCACTCTA
CAGCTTTGACCGCGCGGCTGTGCTGCATGTCTGGGGCCGTCTCTGGAACAGCACCTTTCTGGAGGAGTACTCAGC
TGTGAAGTCCCTGGAAGTGATTGTCCGGGCCAACATCACAGTGAAGTCCTCCATAAAGAACTTGATGCTCCGAGA
TGCCTCCACAGTGATCCCAGTGATGGTATACTTGGACCCCATGGCTGTGGTGGCAGAAGGAGTGCCCTGGTGGGT
CATCCTCCTGGCTGTACTGGCTGGGCTGCTGGTGCTAGCACTGCTGGTGCTGCTCCTGTGGAAGATGGGATTCTT
CAAACGGGCGAAGCACCCCGAGGCCACCGTGCCCCAGTACCATGCGGTGAAGATTCCTCGGGAAGACCGACAGCA
GTTCAAGGAGGAGAAGACGGGCACCATCCTGAGGAACAACTGGGGCAGCCCCCGGCGGGAGGGCCCGGATGCACA
CCCCATCCTGGCTGCTGACGGGCATCCCGAGCTGGGCCCCGATGGGCATCCAGGGCCAGGCACCGCCTAGGTTCC
CATGTCCCAGCCTGGCCTGTGGCTGCCCTCCATCCCTTCCCCAGAGATGGCTCCTTGGGATGAAGAGGGTAGAGT
GGGCTGCTGGTGTCGCATCAAGATTTGGCAGGATCGGCTTCCTCAGGGGCACAGACCTCTCCCACCCACAAGAAC
TCCTCCCACCCAACTTCCCCTTAGAGTGCTGTGAGATGAGAGTGGGTAAATCAGGGACAGGGCCATGGGGTAGGG
TGAGAAGGGCAGGGGTGTCCTGATGCAAAGGTGGGGAGAAGGGATCCTAATCCCTTCCTCTCCCATTCACCCTGT
GTAACAGGACCCCAAGGACCTGCCTCCCCGGAAGTGCCTTAACCTAGAGGGTCGGGGAGGAGGTTGTGTCACTGA
CTCAGGCTGCTCCTTCTCTAGTTTCCCCTCTCATCTGACCTTAGTTTGCTGCCATCAGTCTAGTGGTTTCGTGGT
TTCGTCTATTTATTAAAAAATATTTGAGAACAAAAAAAAAAAAAAAAAAAA

FIGURE 120

></usr/seqdb2/sst/DNA/Dnaseqs.min/ss.DNA55737
><subunit 1 of 1, 1141 aa, 1 stop
><MW: 124671, pI: 5.82, NX(S/T): 5
MAGARSRDPWGASGICYLFGSLLVELLFSRAVAFNLDVMGALRKEGEPGSLFGFSVALHRQLQPRPQSWLLVGAP
QALALPGQQANRTGGLFACPLSLEETDCYRVDIDQGADMQKESKENQWLGVSVRSQGPGGKIVTCAHRYEARQRV
DQILETRDMIGRCFVLSQDLAIRDELDGGEWKFCEGRPQGHEQFGFCQQGTAAAFSPDSHYLLFGAPGTYNWKGT
ARVELCAQGSADLAHLDDGPYEAGGEKEQDPRLIPVPANSYFGFSIDSGKGLVRAEELSFVAGAPRANHKGAVVI
LRKDSASRLVPEVMLSGERLTSGFGYSLAVADLNSDGWPDLIVGAPYFFERQEELGGAVYVYLNQGGHWAGISPL
RLCGSPDSMFGISLAVLGDLNQDGFPDIAVGAPFDGDGKVFIYHGSSLGVVAKPSQVLEGEAVGIKSFGYSLSGS
LDMDGNQYPDLLVGSLADTAVLFRARPILHVSHEVSIAPRSIDLEQPNCAGGHSVCVDLRVCFSYIAVPSSYSPT
VALDYVLDADTDRRLRGQVPRVTFLSRNLEEPKHQASGTVWLKHQHDRVCGDAMFQLQENVKDKLRAIVVTLSYS
LQTPRLRRQAPGQGLPPVAPILNAHQPSTQRAEIHFLKQGCGEDKICQSNLQLVHARFCTRVSDTEFQPLPMDVD
GTTALFALSGQPVIGLELMVTNLPSDPAQPQADGDDAHEAQLLVMLPDSLHYSGVRALDPAEKPLCLSNENASHV
ECELGNPMKRGAQVTFYLILSTSGISIETTELEVELLLATISEQELHPVSARARVFIELPLSIAGMAIPQQLFFS
GVVRGERAMQSERDVGSKVKYEVTVSNQGQSLRTLGSAFLNIMWPHEIANGKWLLYPMQVELEGGQGPGQKGLCS
PRPNILHLDVDSRDRRRRELEPPEQQEPGERQEPSMSWWPVSSAEKKKNITLDCARGTANCVVFSCPLYSFDRAA
VLHVWGRLWNSTFLEEYSAVKSLEVIVRANITVKSSIKNLMLRDASTVIPVMVYLDPMAVVAEGVPWWVILLAVL
AGLLVLALLVLLLWKMGFFKRAKHPEATVPQYHAVKIPREDRQQFKEEKTGTILRNNWGSPRREGPDAHPILAAD
GHPELGPDGHPGPGTA

Important features:
Signal peptide:
amino acids 1-33

Transmembrane domain:
amino acids 1040-1062

N-glycosylation sites.
amino acids 86-89, 746-749, 949-952, 985-988 and 1005-1008

Integrins alpha chain proteins.
amino acids 1064-1071, 384-408, 1041-1071, 317-346, 443-465, 385-407, 215-224, 634-647, 85-99, 322-346, 470-479, 442-466, 379-408 and 1031-1047

FIGURE 121

GGCACGAGGCGGCGGGGCAGTCGCGGGATGCGCCCGGGAGCCACAGCCTGAGGCCCTCAGGTCTCTGCAGGTGTC
GTGGAGGAACCTAGCACCTGCCATCCTCTTCCCCAATTTGCCACTTCCAGCAGCTTTAGCCCATGAGGAGGATGT
GACCGGGACTGAGTCAGGAGCCCTCTGGAAGCATGGAGACTGTGGTGATTGTTGCCATAGGTGTGCTGGCCACCA
TCTTTCTGGCTTCGTTTGCAGCCTTGGTGCTGGTTTGCAGGCAGCGCTACTGCCGGCCGCGAGACCTGCTGCAGC
GCTATGATTCTAAGCCCATTGTGGACCTCATTGGTGCCATGGAGACCCAGTCTGAGCCCTCTGAGTTAGAACTGG
ACGATGTCGTTATCACCAACCCCCACATTGAGGCCATTCTGGAGAATGAAGACTGGATCGAAGATGCCTCGGGTC
TCATGTCCCACTGCATTGCCATCTTGAAGATTTGTCACACTCTGACAGAGAAGCTTGTTGCCATGACAATGGGCT
CTGGGGCCAAGATGAAGACTTCAGCCAGTGTCAGCGACATCATTGTGGTGGCCAAGCGGATCAGCCCCAGGGTGG
ATGATGTTGTGAAGTCGATGTACCCTCCGTTGGACCCCAAACTCCTGGACGCACGGACGACTGCCCTGCTCCTGT
CTGTCAGTCACCTGGTGCTGGTGACAAGGAATGCCTGCCATCTGACGGGAGGCCTGGACTGGATTGACCAGTCTC
TGTCGGCTGCTGAGGAGCATTTGGAAGTCCTTCGAGAAGCAGCCCTAGCTTCTGAGCCAGATAAAGGCCTCCCAG
GCCCTGAAGGCTTCCTGCAGGAGCAGTCTGCAATTTAGTGCCTACAGGCCAGCAGCTAGCCATGAAGGCCCCTGC
CGCCATCCCTGGATGGCTCAGCTTAGCCTTCTACTTTTTCCTATAGAGTTAGTTGTTCTCCACGGCTGGAGAGTT
CAGCTGTGTGTGCATAGTAAAGCAGGAGATCCCCGTCAGTTTATGCCTCTTTTGCAGTTGCAAACTGTGGCTGGT
GAGTGGCAGTCTAATACTACAGTTAGGGGAGATGCCATTCACTCTCTGCAAGAGGAGTATTGAAAACTGGTGGAC
TGTCAGCTTTATTTAGCTCACCTAGTGTTTTCAAGAAAATTGAGCCACCGTCTAAGAAATCAAGAGGTTTCACAT
TAAAATTAGAATTTCTGGCCTCTCTCGATCGGTCAGAATGTGTGGCAATTCTGATCTGCATTTTCAGAAGAGGAC
AATCAATTGAAACTAAGTAGGGGTTTCTTCTTTTGGCAAGACTTGTACTCTCTCACCTGGCCTGTTTCATTTATT
TGTATTATCTGCCTGGTCCCTGAGGCGTCTGGGTCTCTCCTCTCCCTTGCAGGTTTGGGTTTGAAGCTGAGGAAC
TACAAAGTTGATGATTTCTTTTTTATCTTTATGCCTGCAATTTTACCTAGCTACCACTAGGTGGATAGTAAATTT
ATACTTATGTTTCCCTCAAAAAAAAAAAAAAA

FIGURE 122

METVVIVAIGVLATIFLASFAALVLVCRQRYCRPRDLLQRYDSKPIVDLIGAMETQSEPSELELDDVVITNPHIE
AILENEDWIEDASGLMSHCIAILKICHTLTEKLVAMTMGSGAKMKTSASVSDIIVVAKRISPRVDDVVKSMYPPL
DPKLLDARTTALLLSVSHLVLVTRNACHLTGGLDWIDQSLSAAEEHLEVLREAALASEPDKGLPGPEGFLQEQSAI

FIGURE 123

CCCTTACATCCTCCTAGGACCCGGTCGGTAGTCGTCGCCCCAGCCCGCCGGGGGCGCAGCGCCCGAGCCGCGGCC
CTCGAGACGGGACCGAGAGCATCATGGGCAGCACTGTCCCGCGCTCCGCCTCCGTGCTGCTTCTGCTGCTGCTCC
TGCGCCGGGCCGAGCAGCCCTGCGGGGCCGAGCTCACCTTCGAGCTGCCGGACAACGCCAAGCAGTGCTTCCACG
AGGAGGTGGAGCAGGGCGTGAAGTTCTCCCTGGATTACCAGGTCATCACTGGAGGCCACTACGATGTTGACTGCT
ATGTAGAGGACCCCCAGGGGAACACCATCTACAGAGAAACGAAGAAGCAGTACGACAGCTTCACGTACCGGGCTG
AAGTCAAGGGCGTTTATCAGTTTTGCTTCAGTAATGAGTTTTCCACCTTCTCTCACAAGACCGTCTACTTTGACT
TTCAAGTGGGCGATGAGCCTCCCATTCTCCCAGACATGGGGAACAGGGTCACAGCTCTCACCCAGATGGAGTCCG
CCTGCGTGACCATCCATGAGGCTCTGAAAACGGTGATTGACTCCCAGACGCATTACCGGCTGCGGGAGGCCCAGG
ACCGGGCCCGAGCGGAAGACCTTAATAGCCGAGTCTCTTACTGGTCTGTTGGCGAGACGATTGCCCTGTTCGTGG
TCAGCTTCAGTCAGGTGCTACTGTTGAAAAGCTTCTTCACAGAAAAACGACCCATCAGCAGGGCAGTCCACTCCT
AGCCCCGGCATCCTGCTCTAGGGCCCCTCATGCCCCAGGCTGGAGCAGCTCTCCTAGGTCACAGCCTGCTGGGCT
GGGTCGCGTAGCCCAGGGTGGAGGCAGAACGATGCTGCTGTGGTAGCCCTTTGCCTTTCATGCCCATGCTTGATT
CTTGCACCTCAGCAGCTGAAGGTCTCAGAGACCAGTAATCAGAAGGCATCCGACTGCATTAAGTGTGCAGCGCTG
AAAAGACATTTACAACTAGGCCAGGGATTAGCCACTGTGGGAGGGTGGACAGGCAATGGTTCAGTGGCCTGGCTG
TTGGCAGGAACTCCAAGTGCCCAGGCCTCTTGGGCAGCTTAGGGCCCTGCCTCTGTTTCATGATGCATGGGTCAT
TTGTCTTGGGTGTCCTATCCCATATGGAGAAGAAAGGGGCTCTAAGTTCTGGCTCTTCTTTCTTTGGGGTTCTCT
GTACCTGAGGAAACCAGGCCCTGGGTGACTTTGCAGATCTGCTCACCCTCGGTGAGCAACAGTGTCAGCCATGCA
AGCAGGACAGAATGGTGACTGGGTGCCCTTGGTGAGCTGTGTATTTCCTAGGAGGTAGAAAACTGTGGGAAACTG
TGGCTAATAAAAACTAAGTGTGAGCGTCAAAAAAAAAAAAAAAAAAAAAAAAAAAAAA

FIGURE 124

```
</usr/seqdb2/sst/DNA/Dnaseqs.min/ss.DNA56052
<subunit 1 of 1, 217 aa, 1 stop
<MW: 24777, pI: 5.55, NX(S/T): 0
MGSTVPRSASVLLLLLLLRRAEQPCGAELTFELPDNAKQCFHEEVEQGVKFSLDYQVITG
GHYDVDCYVEDPQGNTIYRETKKQYDSFTYRAEVKGVYQFCFSNEFSTFSHKTVYFDFQV
GDEPPILPDMGNRVTALTQMESACVTIHEALKTVIDSQTHYRLREAQDRARAEDLNSRVS
YWSVGETIALFVVSFSQVLLLKSFFTEKRPISRAVHS
```

Important features:
Signal peptide:
amino acids:      1-23

Transmembrane domain:
amino acids:      187-201

N-myristoylation sites:
amino acids:      26-32,48-54,131-137

Tyrosine kinase phosphorylation site:
amino acids:      82-91

Glycosyl hydrolases family 25 proteins:
amino acids:      53-61

FIGURE 125

GGCACGAGGCGCTGTCCACCCGGGGGCGTGGGAGTGAGGTACCAGATTCAGCCCATTTGGCCCCGACGCCTCTGT
TCTCGGAATCCGGGTGCTGCGGATTGAGGTCCCGGTTCCTAACGGACTGCAAGATGGAGGAAGGCGGGAACCTAG
GAGGCCTGATTAAGATGGTCCATCTACTGGTCTTGTCAGGTGCCTGGGGCATGCAAATGTGGGTGACCTTCGTCT
CAGGCTTCCTGCTTTTCCGAAGCCTTCCCCGACATACCTTCGGACTAGTGCAGAGCAAACTCTTCCCCTTCTACT
TCCACATCTCCATGGGCTGTGCCTTCATCAACCTCTGCATCTTGGCTTCACAGCATGCTTGGGCTCAGCTCACAT
TCTGGGAGGCCAGCCAGCTTTACCTGCTGTTCCTGAGCCTTACGCTGGCCACTGTCAACGCCCGCTGGCTGGAAC
CCCGCACCACAGCTGCCATGTGGGCCCTGCAAACCGTGGAGAAGGAGCGAGGCCTGGGTGGGGAGGTACCAGGCA
GCCACCAGGGTCCCGATCCCTACCGCCAGCTGCGAGAGAAGGACCCCAAGTACAGTGCTCTCCGCCAGAATTTCT
TCCGCTACCATGGGCTGTCCTCTCTTTGCAATCTGGGCTGCGTCCTGAGCAATGGGCTCTGTCTCGCTGGCCTTG
CCCTGGAAATAAGGAGCCTCTAGCATGGGCCCTGCATGCTAATAAATGCTTCTTCAGAAATGAAAAAAAAAAAAA
AAAAAA

FIGURE 126

</usr/seqdb2/sst/DNA/Dnaseqs.min/ss.DNA56107
<subunit 1 of 1, 231 aa, 1 stop
<NX(S/T): 0
MEEGGNLGGLIKMVHLLVLSGAWGMQMWVTFVSGFLLFRSLPRHTFGLVQSKLFPFYFHISMGCAFINLCILASQ
HAWAQLTFWEASQLYLLFLSLTLATVNARWLEPRTTAAMWALQTVEKERGLGGEVPGSHQGPDPYRQLREKDPKY
SALRQNFFRYHGLSSLCNLGCVLSNGLCLAGLALEIRSL

Signal peptide:
amino acids 1-24

Transmembrane domain:
amino acids 86-103, 60-75

Casein kinase II phosphorylation site.
amino acids 82-86

Tyrosine kinase phosphorylation site.
amino acids 144-151

N-myristoylation site.
amino acids 4-10, 5-11, 47-53, 170-176, 176-182

Prokaryotic membrane lipoprotein lipid attachment site.
amino acids 54-65

G-protein coupled receptors proteins.
amino acids 44-85

FIGURE 127

GCTTCATTTCTCCCGACTCAGCTTCCCACCCTGGGCTTTCCGAGGTGCTTTCGCCGCTGTCCCCACCACTGCAGC
CATGATCTCCTTAACGGACACGCAGAAAATTGGAATGGGATTAACAGGATTTGGAGTGTTTTTCCTGTTCTTTGG
AATGATTCTCTTTTTTGACAAAGCACTACTGGCTATTGGAAATGTTTTATTTGTAGCCGGCTTGGCTTTTGTAAT
TGGTTTAGAAAGAACATTCAGATTCTTCTTCCAAAAACATAAAATGAAAGCTACAGGTTTTTTTCTGGGTGGTGT
ATTTGTAGTCCTTATTGGTTGGCCTTTGATAGGCATGATCTTCGAAATTTATGGATTTTTTCTCTTGTTCAGGGG
CTTCTTTCCTGTCGTTGTTGGCTTTATTAGAAGAGTGCCAGTCCTTGGATCCCTCCTAAATTTACCTGGAATTAG
ATCATTTGTAGATAAAGTTGGAGAAAGCAACAATATGGTATAACAACAAGTGAATTTGAAGACTCATTTAAAATA
TTGTGTTATTTATAAAGTCATTTGAAGAATATTCAGCACAAAATTAAATTACATGAAATAGCTTGTAATGTTCTT
TACAGGAGTTTAAAACGTATAGCCTACAAAGTACCAGCAGCAAATTAGCAAAGAAGCAGTGAAAACAGGCTTCTA
CTCAAGTGAACTAAGAAGAAGTCAGCAAGCAAACTGAGAGAGGTGAAATCCATGTTAATGATGCTTAAGAAACTC
TTGAAGGCTATTTGTGTTGTTTTTCCACAATGTGCGAAACTCAGCCATCCTTAGAGAACTGTGGTGCCTGTTTCT
TTTCTTTTTATTTTGAAGGCTCAGGAGCATCCATAGGCATTTGCTTTTTAGAAGTGTCCACTGCAATGGCAAAAA
TATTTCCAGTTGCACTGTATCTCTGGAAGTGATGCATGAATTCGATTGGATTGTGTCATTTTAAAGTATTAAAAC
CAAGGAAACCCCAATTTTGATGTATGGATTACTTTTTTTTGNGCNCAGGGCC

FIGURE 128

MISLTDTQKIGMGLTGFGVFFLFFGMILFFDKALLAIGNVLFVAGLAFVIGLERTFRFFFQKHKMKATGFFLGGV
FVVLIGWPLIGMIFEIYGFFLLFRGFFPVVVGFIRRVPVLGSLLNLPGIRSFVDKVGESNNMV

Important features:
Transmembrane domains:
amino acids 12-30 (typeII), 33-52, 69-89 and 93-109

N-myristoylation sites.
amino acids 11-16, 51-56 and 116-121

Aminoacyl-transfer RNA synthetases class-II protein.
amino acids 49-59

FIGURE 129

AATTCAGATTTTAAGCCCATTCTGCAGTGGAATTTCATGAACTAGCAAGAGGACACCATCTTCTTGTATTATACA
AGAAAGGAGTGTACCTATCACACACAGGGGGAAAAATGCTCTTTTGGGTGCTAGGCCTCCTAATCCTCTGTGGTT
TTCTGTGGACTCGTAAAGGAAAACTAAAGATTGAAGACATCACTGATAAGTACATTTTTATCACTGGATGTGACT
CGGGCTTTGGAAACTTGGCAGCCAGAACTTTTGATAAAAAGGGATTTCATGTAATCGCTGCCTGTCTGACTGAAT
CAGGATCAACAGCTTTAAAGGCAGAAACCTCAGAGAGACTTCGTACTGTGCTTCTGGATGTGACCGACCCAGAGA
ATGTCAAGAGGACTGCCCAGTGGGTGAAGAACCAAGTTGGGGAGAAAGGTCTCTGGGGTCTGATCAATAATGCTG
GTGTTCCCGGCGTGCTGGCTCCCACTGACTGGCTGACACTAGAGGACTACAGAGAACCTATTGAAGTGAACCTGT
TTGGACTCATCAGTGTGACACTAAATATGCTTCCTTTGGTCAAGAAAGCTCAAGGGAGAGTTATTAATGTCTCCA
GTGTTGGAGGTCGCCTTGCAATCGTTGGAGGGGGCTATACTCCATCCAAATATGCAGTGGAAGGTTTCAATGACA
GCTTAAGACGGGACATGAAAGCTTTTGGTGTGCACGTCTCATGCATTGAACCAGGATTGTTCAAAACAAACTTGG
CAGATCCAGTAAAGGTAATTGAAAAAAAACTCGCCATTTGGGAGCAGCTGTCTCCAGACATCAAACAACAATATG
GAGAAGGTTACATTGAAAAAAGTCTAGACAAACTGAAAGGCAATAAATCCTATGTGAACATGGACCTCTCTCCGG
TGGTAGAGTGCATGGACCACGCTCTAACAAGTCTCTTCCCTAAGACTCATTATGCCGCTGGAAAAGATGCCAAAA
TTTTCTGGATACCTCTGTCTCACATGCCAGCAGCTTTGCAAGACTTTTTATTGTTGAAACAGAAAGCAGAGCTGG
CTAATCCCAAGGCAGTGTGACTCAGCTAACCACAAATGTCTCCTCCAGGCTATGAAATTGGCCGATTTCAAGAAC
ACATCTCCTTTTCAACCCCATTCCTTATCTGCTCCAACCTGGACTCATTTAGATCGTGCTTATTTGGATTGCAAA
AGGGAGTCCCACCATCGCTGGTGGTATCCCAGGGTCCCTGCTCAAGTTTTCTTTGAAAAGGAGGGCTGGAATGGT
ACATCACATAGGCAAGTCCTGCCCTGTATTTAGGCTTTGCCTGCTTGGTGTGATGTAAGGGAAATTGAAAGACTT
GCCCATTCAAAATGATCTTTACCGTGGCCTGCCCCATGCTTATGGTCCCCAGCATTTACAGTAACTTGTGAATGT
TAAGTATCATCTCTTATCTAAATATTAAAAGATAAGTCAACCCAAAAAAAAAAAAAAAAAAAAAAAAAAAAAAAA
AAAAAAAA

FIGURE 130

></usr/seqdb2/sst/DNA/Dnaseqs.min/ss.DNA56406
><subunit 1 of 1, 319 aa, 1 stop
><MW: 35227, pI: 8.97, NX(S/T): 3
MLFWVLGLLILCGFLWTRKGKLKIEDITDKYIFITGCDSGFGNLAARTFDKKGFHVIAACLTESGSTALKAETSE
RLRTVLLDVTDPENVKRTAQWVKNQVGEKGLWGLINNAGVPGVLAPTDWLTLEDYREPIEVNLFGLISVTLNMLP
LVKKAQGRVINVSSVGGRLAIVGGGYTPSKYAVEGFNDSLRRDMKAFGVHVSCIEPGLFKTNLADPVKVIEKKLA
IWEQLSPDIKQQYGEGYIEKSLDKLKGNKSYVNMDLSPVVECMDHALTSLFPKTHYAAGKDAKIFWIPLSHMPAA
LQDFLLLKQKAELANPKAV

Important features of the protein:
Signal peptide:
amino acids 1-17

Transmembrane domain:
amino acids 136-152

N-glycosylation sites.
amino acids 161-163, 187-190 and 253-256

Glycosaminoglycan attachment site.
amino acids 39-42

N-myristoylation sites.
amino acids 36-41, 42-47, 108-113, 166-171, 198-203 and 207-212

FIGURE 131

AGACAGTACCTCCTCCCTAGGACTACACAAGGACTGAACCAGAAGGAAGAGGACAGAGCAAAGCCATGAACATCA
TCCTAGAAATCCTTCTGCTTCTGATCACCATCATCTACTCCTACTTGGAGTCGTTGGTGAAGTTTTTCATTCCTC
AGAGGAGAAAATCTGTGGCTGGGGAGATTGTTCTCATTACTGGAGCTGGGCATGGAATAGGCAGGCAGACTACTT
ATGAATTTGCAAAACGACAGAGCATATTGGTTCTGTGGGATATTAATAAGCGCGGTGTGGAGGAAACTGCAGCTG
AGTGCCGAAAACTAGGCGTCACTGCGCATGCGTATGTGGTAGACTGCAGCAACAGAGAAGAGATCTATCGCTCTC
TAAATCAGGTGAAGAAAGAAGTGGGTGATGTAACAATCGTGGTGAATAATGCTGGGACAGTATATCCAGCCGATC
TTCTCAGCACCAAGGATGAAGAGATTACCAAGACATTTGAGGTCAACATCCTAGGACATTTTTGGATCACAAAAG
CACTTCTTCCATCGATGATGGAGAGAAATCATGGCCACATCGTCACAGTGGCTTCAGTGTGCGGCCACGAAGGGA
TTCCTTACCTCATCCCATATTGTTCCAGCAAATTTGCCGCTGTTGGCTTTCACAGAGGTCTGACATCAGAACTTC
AGGCCTTGGGAAAAACTGGTATCAAAACCTCATGTCTCTGCCCAGTTTTTGTGAATACTGGGTTCACCAAAAATC
CAAGCACAAGATTATGGCCTGTATTGGAGACAGATGAAGTCGTAAGAAGTCTGATAGATGGAATACTTACCAATA
AGAAAATGATTTTTGTTCCATCGTATATCAATATCTTTCTGAGACTACAGAAGTTTCTTCCTGAACGCGCCTCAG
CGATTTTAAATCGTATGCAGAATATTCAATTTGAAGCAGTGGTTGGCCACAAAATCAAAATGAAATGAATAAATA
AGCTCCAGCCAGAGATGTATGCATGATAATGATATGAATAGTTTCGAATCAATGCTGCAAAGCTTTATTTCACAT
TTTTTCAGTCCTGATAATATTAAAAACATTGGTTTGGCACTAGCAGCAGTCAAACGAACAAGATTAATTACCTGT
CTTCCTGTTTCTCAAGAATATTTACGTAGTTTTTCATAGGTCTGTTTTTCCTTTCATGCCTCTTAAAAACTTCTG
TGCTTACATAAACATACTTAAAAGGTTTTCTTTAAGATATTTTATTTTTCCATTTAAAGGTGGACAAAAGCTACC
TCCCTAAAAGTAAATACAAAGAGAACTTATTTACACAGGGAAGGTTTAAGACTGTTCAAGTAGCATTCCAATCTG
TAGCCATGCCACAGAATATCAACAAGAACACAGAATGAGTGCACAGCTAAGAGATCAAGTTTCAGCAGGCAGCTT
TATCTCAACCTGGACATATTTTAAGATTCAGCATTTGAAAGATTTCCCTAGCCTCTTCCTTTTTCATTAGCCCAA
AACGGTGCAACTCTATTCTGGACTTTATTACTTGATTCTGTCTTCTGTATAACTCTGAAGTCCACCAAAAGTGGA
CCCTCTATATTTCCTCCCTTTTTATAGTCTTATAAGATACATTATGAAAGGTGACCGACTCTATTTTAAATCTCA
GAATTTTAAGTTCTAGCCCCATGATAACCTTTTTCTTTGTAATTTATGCTTTCATATATCCTTGGTCCCAGAGAT
GTTTAGACAATTTTAGGCTCAAAAATTAAAGCTAACACAGGAAAAGGAACTGTACTGGCTATTACATAAGAAACA
ATGGACCCAAGAGAAGAA

FIGURE 132

</usr/seqdb2/sst/DNA/Dnaseqs.min/ss.DNA56409
<subunit 1 of 1, 300 aa, 1 stop
<MW: 33655, pI: 9.31, NX(S/T): 1
MNIILEILLLLITIIYSYLESLVKFFIPQRRKSVAGEIVLITGAGHGIGRQTTYEFAKRQSILVLWDINKRGVEE
TAAECRKLGVTAHAYVVDCSNREEIYRSLNQVKKEVGDVTIVVNNAGTVYPADLLSTKDEEITKTFEVNILGHFW
ITKALLPSMMERNHGHIVTVASVCGHEGIPYLIPYCSSKFAAVGFHRGLTSELQALGKTGIKTSCLCPVFVNTGF
TKNPSTRLWPVLETDEVVRSLIDGILTNKKMIFVPSYINIFLRLQKFLPERASAILNRMQNIQFEAVVGHKIKMK

Important features:
Signal peptide:
amino acids 1-19 cAMP- and cGMP-dependent protein kinase phosphorylation site.
amino acids 30-33 and 58-61

Short-chain alcohol dehydrogenase family protein
amino acids 165-202, 37-49, 112-122 and 210-219

FIGURE 133

CTGAGGCGGCGGTAGCATGGAGGGGGAGAGTACGTCGGCGGTGCTCTCGGGCTTTGTGCTCGGCGCACTCGCTTT
CCAGCACCTCAACACGGACTCGGACACGGAAGGTTTTCTTCTTGGGGAAGTAAAAGGTGAAGCCAAGAACAGCAT
TACTGATTCCCAAATGGATGATGTTGAAGTTGTTTATACAATTGACATTCAGAAATATATTCCATGCTATCAGCT
TTTTAGCTTTTATAATTCTTCAGGCGAAGTAAATGAGCAAGCACTGAAGAAAATATTATCAAATGTCAAAAAGAA
TGTGGTAGGTTGGTACAAATTCCGTCGTCATTCAGATCAGATCATGACGTTTAGAGAGAGGCTGCTTCACAAAAA
CTTGCAGGAGCATTTTTCAAACCAAGACCTTGTTTTTCTGCTATTAACACCAAGTATAATAACAGAAAGCTGCTC
TACTCATCGACTGGAACATTCCTTATATAAACCTCAAAAAGGACTTTTTCACAGGGTACCTTTAGTGGTTGCCAA
TCTGGGCATGTCTGAACAACTGGGTTATAAAACTGTATCAGGTTCCTGTATGTCCACTGGTTTTAGCCGAGCAGT
ACAAACACACAGCTCTAAATTTTTTGAAGAAGATGGATCCTTAAAGGAGGTACATAAGATAAATGAAATGTATGC
TTCATTACAAGAGGAATTAAAGAGTATATGCAAAAAAGTGGAAGACAGTGAACAAGCAGTAGATAAACTAGTAAA
GGATGTAAACAGATTAAAACGAGAAATTGAGAAAAGGAGAGGAGCACAGATTCAGGCAGCAAGAGAGAAGAACAT
CCAAAAAGACCCTCAGGAGAACATTTTTCTTTGTCAGGCATTACGGACCTTTTTTCCAAATTCTGAATTTCTTCA
TTCATGTGTTATGTCTTTAAAAAATAGACATGTTTCTAAAAGTAGCTGTAACTACAACCACCATCTCGATGTAGT
AGACAATCTGACCTTAATGGTAGAACACACTGACATTCCTGAAGCTAGTCCAGCTAGTACACCACAAATCATTAA
GCATAAAGCCTTAGACTTAGATGACAGATGGCAATTCAAGAGATCTCGGTTGTTAGATACACAAGACAAACGATC
TAAAGCAAATACTGGTAGTAGTAACCAAGATAAAGCATCCAAAATGAGCAGCCCAGAAACAGATGAAGAAATTGA
AAAGATGAAGGGTTTTGGTGAATATTCACGGTCTCCTACATTTTGATCCTTTTAACCTTACAAGGAGATTTTTTT
ATTTGGCTGATGGGTAAAGCCAAACATTTCTATTGTTTTTACTATGTTGAGCTACTTGCAGTAAGTTCATTTGTT
TTTACTATGTTCACCTGTTTGCAGTAATACACAGATAACTCTTAGTGCATTTACTTCACAAAGTACTTTTTCAAA
CATCAGATGCTTTTATTTCCAAACCTTTTTTTCACCTTTCACTAAGTTGTTGAGGGGAAGGCTTACACAGACACA
TTCTTTAGAATTGGAAAAGTGAGACCAGGCACAGTGGCTCACACCTGTAATCCCAGCACTTAGGGAAGACAAGTC
AGGAGGATTGATTGAAGCTAGGAGTTAGAGACCAGCCTGGGCAACGTATTGAGACCATGTCTATTAAAAAATAAA
ATGGAAAAGCAAGAATAGCCTTATTTTCAAAATATGGAAAGAAATTTATATGAAAATTTATCTGAGTCATTAAAA
TTCTCCTTAAGTGATACTTTTTTAGAAGTACATTATGGCTAGAGTTGCCAGATAAAATGCTGGATATCATGCAAT
AAATTTGCAAAACATCATCTAAAATTTAAAAAAAAAAAAAAAAAAAAA

FIGURE 134

MEGESTSAVLSGFVLGALAFQHLNTDSDTEGFLLGEVKGEAKNSITDSQMDDVEVVYTIDIQKYIPCYQLFSFYN
SSGEVNEQALKKILSNVKKNVVGWYKFRRHSDQIMTFRERLLHKNLQEHFSNQDLVFLLLTPSIITESCSTHRLE
HSLYKPQKGLFHRVPLVVANLGMSEQLGYKTVSGSCMSTGFSRAVQTHSSKFFEEDGSLKEVHKINEMYASLQEE
LKSICKKVEDSEQAVDKLVKDVNRLKREIEKRRGAQIQAAREKNIQKDPQENIFLCQALRTFFPNSEFLHSCVMS
LKNRHVSKSSCNYNHHLDVVDNLTLMVEHTDIPEASPASTPQIIKHKALDLDDRWQFKRSRLLDTQDKRSKANTG
SSNQDKASKMSSPETDEEIEKMKGFGEYSRSPTF

FIGURE 135

GGCACAGCCGCGCGGCGGAGGGCAGAGTCAGCCGAGCCGAGTCCAGCCGGACGAGCGGACCAGCGCAGGGCAGCC
CAAGCAGCGCGCAGCGAACGCCCGCCGCCGCCCACACCCTCTGCGGTCCCCGCGGCGCCTGCCACCCTTCCCTCC
TTCCCCGCGTCCCCGCCTCGCCGGCCAGTCAGCTTGCCGGGTTCGCTGCCCCGCGAAACCCCGAGGTCACCAGCC
CGCGCCTCTGCTTCCCTGGGCCGCGCGCCGCCTCCACGCCCTCCTTCTCCCCTGGCCCGGCGCCTGGCACCGGGG
ACCGTTGCCTGACGCGAGGCCCAGCTCTACTTTTCGCCCCGCGTCTCCTCCGCCTGCTCGCCTCTTCCACCAACT
CCAACTCCTTCTCCCTCCAGCTCCACTCGCTAGTCCCCGACTCCGCCAGCCCTCGGCCCGCTGCCGTAGCGCCGC
TTCCCGTCCGGTCCCAAAGGTGGAACGCGTCCGCCCCGGCCCGCACCATGGCACGGTTCGGCTTGCCCGCGCTT
CTCTGCACCCTGGCAGTGCTCAGCGCCGCGCTGCTGGCTGCCGAGCTCAAGTCGAAAAGTTGCTCGGAAGTGCGA
CGTCTTTACGTGTCCAAAGGCTTCAACAAGAACGATGCCCCCCTCCACGAGATCAACGGTGATCATTTGAAGATC
TGTCCCCAGGGTTCTACCTGCTGCTCTCAAGAGATGGAGGAGAAGTACAGCCTGCAAAGTAAAGATGATTTCAAA
AGTGTGGTCAGCGAACAGTGCAATCATTTGCAAGCTGTCTTTGCTTCACGTTACAAGAAGTTTGATGAATTCTTC
AAAGAACTACTTGAAAATGCAGAGAAATCCCTGAATGATATGTTTGTGAAGACATATGGCCATTTATACATGCAA
AATTCTGAGCTATTTAAAGATCTCTTCGTAGAGTTGAAACGTTACTACGTGGTGGGAAATGTGAACCTGGAAGAA
ATGCTAAATGACTTCTGGGCTCGCCTCCTGGAGCGGATGTTCCGCCTGGTGAACTCCCAGTACCACTTTACAGAT
GAGTATCTGGAATGTGTGAGCAAGTATACGGAGCAGCTGAAGCCCTTCGGAGATGTCCCTCGCAAATTGAAGCTC
CAGGTTACTCGTGCTTTTGTAGCAGCCCGTACTTTCGCTCAAGGCTTAGCGGTTGCGGGAGATGTCGTGAGCAAG
GTCTCCGTGGTAAACCCCACAGCCCAGTGTACCCATGCCCTGTTGAAGATGATCTACTGCTCCCACTGCCGGGGT
CTCGTGACTGTGAAGCCATGTTACAACTACTGCTCAAACATCATGAGAGGCTGTTTGGCCAACCAAGGGGATCTC
GATTTTGAATGGAACAATTTCATAGATGCTATGCTGATGGTGGCAGAGAGGCTAGAGGGTCCTTTCAACATTGAA
TCGGTCATGGATCCCATCGATGTGAAGATTTCTGATGCTATTATGAACATGCAGGATAATAGTGTTCAAGTGTCT
CAGAAGGTTTTCCAGGGATGTGGACCCCCCAAGCCCCTCCCAGCTGGACGAATTTCTCGTTCCATCTCTGAAAGT
GCCTTCAGTGCTCGCTTCAGACCACATCACCCCGAGGAACGCCCAACCACAGCAGCTGGCACTAGTTTGGACCGA
CTGGTTACTGATGTCAAGGAGAAACTGAAACAGGCCAAGAAATTCTGGTCCTCCCTTCCGAGCAACGTTTGCAAC
GATGAGAGGATGGCTGCAGGAAACGGCAATGAGGATGACTGTTGGAATGGGAAAGGCAAAAGCAGGTACCTGTTT
GCAGTGACAGGAAATGGATTAGCCAACCAGGGCAACAACCCAGAGGTCCAGGTTGACACCAGCAAACCAGACATA
CTGATCCTTCGTCAAATCATGGCTCTTCGAGTGATGACCAGCAAGATGAAGAATGCATACAATGGGAACGACGTG
GACTTCTTTGATATCAGTGATGAAAGTAGTGGAGAAGGAAGTGGAAGTGGCTGTGAGTATCAGCAGTGCCCTTCA
GAGTTTGACTACAATGCCACTGACCATGCTGGGAAGAGTGCCAATGAGAAAGCCGACAGTGCTGGTGTCCGTCCT
GGGGCACAGGCCTACCTCCTCACTGTCTTCTGCATCTTGTTCCTGGTTATGCAGAGAGAGTGGAGATAATTCTCA
AACTCTGAGAAAAAGTGTTCATCAAAAAGTTAAAAGGCACCAGTTATCACTTTTCTACCATCCTAGTGACTTTGC
TTTTTAAATGAATGGACAACAATGTACAGTTTTTACTATGTGGCCACTGGTTTAAGAAGTGCTGACTTTGTTTTC
TCATTCAGTTTTGGGAGGAAAAGGGACTGTGCATTGAGTTGGTTCCTGCTCCCCCAAACCATGTTAAACGTGGCT
AACAGTGTAGGTACAGAACTATAGTTAGTTGTGCATTTGTGATTTTATCACTCTATTATTTGTTTGTATGTTTTT
TTCTCATTTCGTTTGTGGGTTTTTTTTTCCAACTGTGATCTCGCCTTGTTTCTTACAAGCAAACCAGGGTCCCTT
CTTGGCACGTAACATGTACGTATTTCTGAAATATTAAATAGCTGTACAGAAGCAGGTTTTATTTATCATGTTATC
TTATTAAAAGAAAAAGCCCAAAAAGC

FIGURE 136

MARFGLPALLCTLAVLSAALLAAELKSKSCSEVRRLYVSKGFNKNDAPLHEINGDHLKICPQGSTCCSQEMEEKY
SLQSKDDFKSVVSEQCNHLQAVFASRYKKFDEFFKELLENAEKSLNDMFVKTYGHLYMQNSELFKDLFVELKRYY
VVGNVNLEEMLNDFWARLLERMFRLVNSQYHFTDEYLECVSKYTEQLKPFGDVPRKLKLQVTRAFVAARTFAQGL
AVAGDVVSKVSVVNPTAQCTHALLKMIYCSHCRGLVTVKPCYNYCSNIMRGCLANQGDLDFEWNNFIDAMLMVAE
RLEGPFNIESVMDPIDVKISDAIMNMQDNSVQVSQKVFQGCGPPKPLPAGRISRSISESAFSARFRPHHPEERPT
TAAGTSLDRLVTDVKEKLKQAKKFWSSLPSNVCNDERMAAGNGNEDDCWNGKGKSRYLFAVTGNGLANQGNNPEV
QVDTSKPDILILRQIMALRVMTSKMKNAYNGNDVDFFDISDESSGEGSGSGCEYQQCPSEFDYNATDHAGKSANE
KADSAGVRPGAQAYLLTVFCILFLVMQREWR

FIGURE 137

GCGGGCTGTTGACGGCGCTGCGATGGCTGCCTGCGAGGGCAGGAGAAGCGGAGCTCTCGGTTCCTCTCAGTCGGA
CTTCCTGACGCCGCCAGTGGGCGGGGCCCCTTGGGCCGTCGCCACCACTGTAGTCATGTACCCACCGCCGCCGCC
GCCGCCTCATCGGGACTTCATCTCGGTGACGCTGAGCTTTGGCGAGAGCTATGACAACAGCAAGAGTTGGCGGCG
GCGCTCGTGCTGGAGGAAATGGAAGCAACTGTCGAGATTGCAGCGGAATATGATTCTCTTCCTCCTTGCCTTTCT
GCTTTTCTGTGGACTCCTCTTCTACATCAACTTGGCTGACCATTGGAAAGCTCTGGCTTTCAGGCTAGAGGAAGA
GCAGAAGATGAGGCCAGAAATTGCTGGGTTAAAACCAGCAAATCCACCCGTCTTACCAGCTCCTCAGAAGGCGGA
CACCGACCCTGAGAACTTACCTGAGATTTCGTCACAGAAGACACAAAGACACATCCAGCGGGGACCACCTCACCT
GCAGATTAGACCCCCAAGCCAAGACCTGAAGGATGGGACCCAGGAGGAGGCCACAAAAAGGCAAGAAGCCCCTGT
GGATCCCCGCCCGGAAGGAGATCCGCAGAGGACAGTCATCAGCTGGAGGGGAGCGGTGATCGAGCCTGAGCAGGG
CACCGAGCTCCCTTCAAGAAGAGCAGAAGTGCCCACCAAGCCTCCCCTGCCACCGGCCAGGACACAGGGCACACC
AGTGCATCTGAACTATCGCCAGAAGGGCGTGATTGACGTCTTCCTGCATGCATGGAAAGGATACCGCAAGTTTGC
ATGGGGCCATGACGAGCTGAAGCCTGTGTCCAGGTCCTTCAGTGAGTGGTTTGGCCTCGGTCTCACACTGATCGA
CGCGCTGGACACCATGTGGATCTTGGGTCTGAGGAAAGAATTTGAGGAAGCCAGGAAGTGGGTGTCGAAGAAGTT
ACACTTTGAAAAGGACGTGGACGTCAACCTGTTTGAGAGCACGATCCGCATCCTGGGGGGGCTCCTGAGTGCCTA
CCACCTGTCTGGGGACAGCCTCTTCCTGAGGAAAGCTGAGGATTTTGGAAATCGGCTAATGCCTGCCTTCAGAAC
ACCATCCAAGATTCCTTACTCGGATGTGAACATCGGTACTGGAGTTGCCCACCCGCCACGGTGGACCTCCGACAG
CACTGTGGCCGAGGTGACCAGCATTCAGCTGGAGTTCCGGGAGCTCTCCCGTCTCACAGGGGATAAGAAGTTTCA
GGAGGCAGTGGAGAAGGTGACACAGCACATCCACGGCCTGTCTGGGAAGAAGGATGGGCTGGTGCCCATGTTCAT
CAATACCCACAGTGGCCTCTTCACCCACCTGGGCGTATTCACGCTGGGCGCCAGGGCCGACAGCTACTATGAGTA
CCTGCTGAAGCAGTGGATCCAGGGCGGGAAGCAGGAGACACAGCTGCTGGAAGACTACGTGGAAGCCATCGAGGG
TGTCAGAACGCACCTGCTGCGGCACTCCGAGCCCAGTAAGCTCACCTTTGTGGGGGAGCTTGCCCACGGCCGCTT
CAGTGCCAAGATGGACCACCTGGTGTGCTTCCTGCCAGGGACGCTGGCTCTGGGCGTCTACCACGGCCTGCCCGC
CAGCCACATGGAGCTGGCCCAGGAGCTCATGGAGACTTGTTACCAGATGAACCGGCAGATGGAGACGGGGCTGAG
TCCCGAGATCGTGCACTTCAACCTTTACCCCCAGCCGGGCCGTCGGGACGTGGAGGTCAAGCCAGCAGACAGGCA
CAACCTGCTGCGGCCAGAGACCGTGGAGAGCCTGTTCTACCTGTACCGCGTCACAGGGGACCGCAAATACCAGGA
CTGGGGCTGGGAGATTCTGCAGAGCTTCAGCCGATTCACACGGGTCCCCTCGGGTGGCTATTCTTCCATCAACAA
TGTCCAGGATCCTCAGAAGCCCGAGCCTAGGGACAAGATGGAGAGCTTCTTCCTGGGGGAGACGCTCAAGTATCT
GTTCTTGCTCTTCTCCGATGACCCAAACCTGCTCAGCCTGGACGCCTACGTGTTCAACACCGAAGCCCACCCTCT
GCCTATCTGGACCCCTGCCTAGGGTGGATGGCTGCTGGTGTGGGGACTTCGGGTGGCAGAGGCACCTTGCTGGG
TCTGTGGCATTTTCCAAGGGCCCACGTAGCACCGGCAACCGCCAAGTGGCCCAGGCTCTGAACTGGCTCTGGGCT
CCTCCTCGTCTCTGCTTTAATCAGGACACCGTGAGGACAAGTGAGGCCGTCAGTCTTGGTGTGATGCGGGGTGGG
CTGGGCCGCTGGAGCCTCCGCCTGCTTCCTCCAGAAGACACGAATCATGACTCACGATTGCTGAAGCCTGAGCAG
GTCTCTGTGGGCCGACCAGAGGGGGGCTTCGAGGTGGTCCCTGGTACTGGGGTGACCGAGTGGACAGCCCAGGGT
GCAGCTCTGCCCGGGCTCGTGAAGCCTCAGATGTCCCCAATCCAAGGGTCTGGAGGGGCTGCCGTGACTCCAGAG
GCCTGAGGCTCCAGGGCTGGCTCTGGTGTTTACAAGCTGGACTCAGGGATCCTCCTGGCCGCCCCGCAGGGGGCT
TGGAGGGCTGGACGGCAAGTCCGTCTAGCTCACGGCCCCTCCAGTGGAATGGGTCTTTTCGGTGGAGATAAAAG
TTGATTTGCTCTAACCGCAA

FIGURE 138

></usr/seqdb2/sst/DNA/Dnaseqs.min/ss.DNA56529
><subunit 1 of 1, 699 aa, 1 stop
><MW: 79553, pI: 7.83, NX(S/T): 0
MAACEGRRSGALGSSQSDFLTPPVGGAPWAVATTVVMYPPPPPPPHRDFISVTLSFGESYDNSKSWRRRSCWRKW
KQLSRLQRNMILFLLAFLLFCGLLFYINLADHWKALAFRLEEEQKMRPEIAGLKPANPPVLPAPQKADTDPENLP
EISSQKTQRHIQRGPPHLQIRPPSQDLKDGTQEEATKRQEAPVDPRPEGDPQRTVISWRGAVIEPEQGTELPSRR
AEVPTKPPLPPARTQGTPVHLNYRQKGVIDVFLHAWKGYRKFAWGHDELKPVSRSFSEWFGLGLTLIDALDTMWI
LGLRKEFEEARKWVSKKLHFEKDVDVNLFESTIRILGGLLSAYHLSGDSLFLRKAEDFGNRLMPAFRTPSKIPYS
DVNIGTGVAHPPRWTSDSTVAEVTSIQLEFRELSRLTGDKKFQEAVEKVTQHIHGLSGKKDGLVPMFINTHSGLF
THLGVFTLGARADSYYEYLLKQWIQGGKQETQLLEDYVEAIEGVRTHLLRHSEPSKLTFVGELAHGRFSAKMDHL
VCFLPGTLALGVYHGLPASHMELAQELMETCYQMNRQMETGLSPEIVHFNLYPQPGRRDVEVKPADRHNLLRPET
VESLFYLYRVTGDRKYQDWGWEILQSFSRFTRVPSGGYSSINNVQDPQKPEPRDKMESFFLGETLKYLFLLFSDD
PNLLSLDAYVFNTEAHPLPIWTPA

Important features of the protein:
Transmembrane domain:
amino acids 21-40 and 84-105 (type II)

FIGURE 139

CTCGCCCTCAAATGGGAACGCTGGCCTGGGACTAAAGCATAGACCACCAGGCTGAGTATCCTGACCTGAGTCATC
CCCAGGGATCAGGAGCCTCCAGCAGGGAACCTTCCATTATATTCTTCAAGCAACTTACAGCTGCACCGACAGTTG
CGATGAAAGTTCTAATCTCTTCCCTCCTCCTGTTGCTGCCACTAATGCTGATGTCCATGGTCTCTAGCAGCCTGA
ATCCAGGGGTCGCCAGAGGCCACAGGGACCGAGGCCAGGCTTCTAGGAGATGGCTCCAGGAAGGCGGCCAAGAAT
GTGAGTGCAAAGATTGGTTCCTGAGAGCCCCGAGAAGAAAATTCATGACAGTGTCTGGGCTGCCAAAGAAGCAGT
GCCCCTGTGATCATTTCAAGGGCAATGTGAAGAAAACAAGACACCAAAGGCACCACAGAAAGCCAAACAAGCATT
CCAGAGCCTGCCAGCAATTTCTCAAACAATGTCAGCTAAGAAGCTTTGCTCTGCCTTTGTAGGAGCTCTGAGCGC
CCACTCTTCCAATTAAACATTCTCAGCCAAGAAGACAGTGAGCACACCTACCAGACACTCTTCTTCTCCCACCTC
ACTCTCCCACTGTACCCACCCCTAAATCATTCCAGTGCTCTCAAAAAGCATGTTTTTCAAGATCATTTTGTTTGT
TGCTCTCTCTAGTGTCTTCTTCTCTCGTCAGTCTTAGCCTGTGCCCTCCCCTTACCCAGGCTTAGGCTTAATTAC
CTGAAAGATTCCAGGAAACTGTAGCTTCCTAGCTAGTGTCATTTAACCTTAAATGCAATCAGGAAAGTAGCAAAC
AGAAGTCAATAAATATTTTTAAATGTCAAAAAAAAAAAAAAAAAA

FIGURE 140

MKVLISSLLLLLPLMLMSMVSSSLNPGVARGHRDRGQASRRWLQEGGQECECKDWFLRAPRRKFMTVSGLPKKQC
PCDHFKGNVKKTRHQRHHRKPNKHSRACQQFLKQCQLRSFALPL

FIGURE 141

AATGGCTGTCTTAGTACTTCGCCTGACAGTTGTCCTGGGACTGCTTGTCTTATTCCTGACCTGCTATGCAGACGA
CAAACCAGACAAGCCAGACGACAAGCCAGACGACTCGGGCAAAGACCCAAAGCCAGACTTCCCCAAATTCCTAAG
CCTCCTGGGCACAGAGATCATTGAGAATGCAGTCGAGTTCATCCTCCGCTCCATGTCCAGGAGCACAGGATTTAT
GGAATTTGATGATAATGAAGGAAAACATTCATCAAAGTGACATCCTCAGGACACACCCATGTGGCTCCTGGACAA
TCCAAGAGCAGCCAAATCCTGCTTTTCCAGTTTGGCTCCACAAGTCCTCCAGGACAGAGCCCTCAAAGCAACTCC
CAACGAGTTCTCAGGATTCAGGCTCTGGCTTCAACCAAACAGAACTCATTTTGAACACCCTGACTGCATTTTTGC
TTTTAGAAAGTTAGAATAAATATGGCGCTTTGGGATCACATAGTTGATGGAGAGGAAAAAAAAAAAAAAAAAAAA
AAAAAAAAAAAAAAAAAAAAAAAAAA

FIGURE 142

MAVLVLRLTVVLGLLVLFLTCYADDKPDKPDDKPDDSGKDPKPDFPKFLSLLGTEIIENAVEFILRSMSRSTGFM
EFDDNEGKHSSK

FIGURE 143

GGACGCCAGCGCCTGCAGAGGCTGAGCAGGGAAAAAGCCAGTGCCCCAGCGGAAGCACAGCTCAGAGCTGGTCTG
CCATGGACATCCTGGTCCCACTCCTGCAGCTGCTGGTGCTGCTTCTTACCCTGCCCCTGCACCTCATGGCTCTGC
TGGGCTGCTGGCAGCCCCTGTGCAAAAGCTACTTCCCCTACCTGATGGCCGTGCTGACTCCCAAGAGCAACCGCA
AGATGGAGAGCAAGAAACGGGAGCTCTTCAGCCAGATAAAGGGGCTTACAGGAGCCTCCGGGAAAGTGGCCCTAC
TGGAGCTGGGCTGCGGAACCGGAGCCAACTTTCAGTTCTACCCACCGGGCTGCAGGGTCACCTGCCTAGACCCAA
ATCCCCACTTTGAGAAGTTCCTGACAAAGAGCATGGCTGAGAACAGGCACCTCCAATATGAGCGGTTTGTGGTGG
CTCCTGGAGAGGACATGAGACAGCTGGCTGATGGCTCCATGGATGTGGTGGTCTGCACTCTGGTGCTGTGCTCTG
TGCAGAGCCCAAGGAAGGTCCTGCAGGAGGTCCGGAGAGTACTGAGACCGGGAGGTGTGCTCTTTTTCTGGGAGC
ATGTGGCAGAACCATATGGAAGCTGGGCCTTCATGTGGCAGCAAGTTTTCGAGCCCACCTGGAAACACATTGGGG
ATGGCTGCTGCCTCACCAGAGAGACCTGGAAGGATCTTGAGAACGCCCAGTTCTCCGAAATCCAAATGGAACGAC
AGCCCCCTCCCTTGAAGTGGCTACCTGTTGGGCCCCACATCATGGGAAAGGCTGTCAAACAATCTTTCCCAAGCT
CCAAGGCACTCATTTGCTCCTTCCCCAGCCTCCAATTAGAACAAGCCACCCACCAGCCTATCTATCTTCCACTGA
GAGGGACCTAGCAGAATGAGAGAAGACATTCATGTACCACCTACTAGTCCCTCTCTCCCCAACCTCTGCCAGGGC
AATCTCTAACTTCAATCCCGCCTTCGACAGTGAAAAAGCTCTACTTCTACGCTGACCCAGGGAGGAAACACTAGG
ACCCTGTTGTATCCTCAACTGCAAGTTTCTGGACTAGTCTCCCAACGTTTGCCTCCCAATGTTGTCCCTTTCCTT
CGTTCCCATGGTAAAGCTCCTCTCGCTTTCCTCCTGAGGCTACACCCATGCGTCTCTAGGAACTGGTCACAAAAG
TCATGGTGCCTGCATCCCTGCCAAGCCCCCCTGACCCTCTCTCCCCACTACCACCTTCTTCCTGAGCTGGGGGCA
CCAGGGAGAATCAGAGATGCTGGGGATGCCAGAGCAAGACTCAAAGAGGCAGAGGTTTTGTTCTCAAATATTTTT
TAATAAATAGACGAAACCACG

FIGURE 144

MDILVPLLQLLVLLLTLPLHLMALLGCWQPLCKSYFPYLMAVLTPKSNRKMESKKRELFSQIKGLTGASGKVALL
ELGCGTGANFQFYPPGCRVTCLDPNPHFEKFLTKSMAENRHLQYERFVVAPGEDMRQLADGSMDVVVCTLVLCSV
QSPRKVLQEVRRVLRPGGVLFFWEHVAEPYGSWAFMWQQVFEPTWKHIGDGCCLTRETWKDLENAQFSEIQMERQ
PPPLKWLPVGPHIMGKAVKQSFPSSKALICSFPSLQLEQATHQPIYLPLRGT

FIGURE 145

GTGGGATTTATTTGAGTGCAAGATCGTTTTCTCAGTGGTGGTGGAAGTTGCCTCATCGCAGGCAGATGTTGGGGC
TTTGTCCGAACAGCTCCCCTCTGCCAGCTTCTGTAGATAAGGGTTAAAAACTAATATTTATATGACAGAAGAAAA
AGATGTCATTCCGTAAAGTAAACATCATCATCTTGGTCCTGGCTGTTGCTCTCTTCTTACTGGTTTTGCACCATA
ACTTCCTCAGCTTGAGCAGTTTGTTAAGGAATGAGGTTACAGATTCAGGAATTGTAGGGCCTCAACCTATAGACT
TTGTCCCAAATGCTCTCCGACATGCAGTAGATGGGAGACAAGAGGAGATTCCTGTGGTCATCGCTGCATCTGAAG
ACAGGCTTGGGGGGGCCATTGCAGCTATAAACAGCATTCAGCACAACACTCGCTCCAATGTGATTTTCTACATTG
TTACTCTCAACAATACAGCAGACCATCTCCGGTCCTGGCTCAACAGTGATTCCCTGAAAAGCATCAGATACAAAA
TTGTCAATTTTGACCCTAAACTTTTGGAAGGAAAAGTAAAGGAGGATCCTGACCAGGGGGAATCCATGAAACCTT
TAACCTTTGCAAGGTTCTACTTGCCAATTCTGGTTCCCAGCGCAAAGAAGGCCATATACATGGATGATGATGTAA
TTGTGCAAGGTGATATTCTTGCCCTTTACAATACAGCACTGAAGCCAGGACATGCAGCTGCATTTTCAGAAGATT
GTGATTCAGCCTCTACTAAAGTTGTCATCCGTGGAGCAGGAAACCAGTACAATTACATTGGCTATCTTGACTATA
AAAAGGAAAGAATTCGTAAGCTTTCCATGAAAGCCAGCACTTGCTCATTTAATCCTGGAGTTTTTGTTGCAAACC
TGACGGAATGGAAACGACAGAATATAACTAACCAACTGGAAAAATGGATGAAACTCAATGTAGAAGAGGGACTGT
ATAGCAGAACCCTGGCTGGTAGCATCACAACACCTCCTCTGCTTATCGTATTTTATCAACAGCACTCTACCATCG
ATCCTATGTGGAATGTCCGCCACCTTGGTTCCAGTGCTGGAAAACGATATTCACCTCAGTTTGTAAAGGCTGCCA
AGTTACTCCATTGGAATGGACATTTGAAGCCATGGGGAAGGACTGCTTCATATACTGATGTTTGGGAAAAATGGT
ATATTCCAGACCCAACAGGCAAATTCAACCTAATCCGAAGATATACCGAGATCTCAAACATAAAGTGAAACAGAA
TTTGAACTGTAAGCAAGCATTTCTCAGGAAGTCCTGGAAGATAGCATGCATGGGAAGTAACAGTTGCTAGGCTTC
AATGCCTATCGGTAGCAAGCCATGGAAAAAGATGTGTCAGCTAGGTAAAGATGACAAACTGCCCTGTCTGGCAGT
CAGCTTCCCAGACAGACTATAGACTATAAATATGTCTCCATCTGCCTTACCAAGTGTTTTCTTACTACAATGCTG
AATGACTGGAAAGAAGAACTGATATGGCTAGTTCAGCTAGCTGGTACAGATAATTCAAAACTGCTGTTGGTTTTA
ATTTTGTAACCTGTGGCCTGATCTGTAAATAAAACTTACATTTTTC

FIGURE 146

MSFRKVNIIILVLAVALFLLVLHHNFLSLSSLLRNEVTDSGIVGPQPIDFVPNALRHAVDGRQEEIPVVIAASED
RLGGAIAAINSIQHNTRSNVIFYIVTLNNTADHLRSWLNSDSLKSIRYKIVNFDPKLLEGKVKEDPDQGESMKPL
TFARFYLPILVPSAKKAIYMDDDVIVQGDILALYNTALKPGHAAAFSEDCDSASTKVVIRGAGNQYNYIGYLDYK
KERIRKLSMKASTCSFNPGVFVANLTEWKRQNITNQLEKWMKLNVEEGLYSRTLAGSITTPPLLIVFYQQHSTID
PMWNVRHLGSSAGKRYSPQFVKAAKLLHWNGHLKPWGRTASYTDVWEKWYIPDPTGKFNLIRRYTEISNIK

FIGURE 147

GTTTGAATTCCTTCAACTATACCCACAGTCCAAAAGCAGACTCACTGTGTCCCAGGCTACCAGTTCCTCCAAGCA
AGTCATTTCCCTTATTTAACCGATGTGTCCCTCAAACACCTGAGTGCTACTCCCTATTTGCATCTGTTTTGATAA
ATGATGTTGACACCCTCCACCGAATTCTAAGTGGAATCATGTCGGGAAGAGATACAATCCTTGGCCTGTGTATCC
TCGCATTAGCCTTGTCTTTGGCCATGATGTTTACCTTCAGATTCATCACCACCCTTCTGGTTCACATTTTCATTT
CATTGGTTATTTTGGGATTGTTGTTTGTCTGCGGTGTTTTATGGTGGCTGTATTATGACTATACCAACGACCTCA
GCATAGAATTGGACACAGAAAGGGAAAATATGAAGTGCGTGCTGGGGTTTGCTATCGTATCCACAGGCATCACGG
CAGTGCTGCTCGTCTTGATTTTTGTTCTCAGAAAGAGAATAAAATTGACAGTTGAGCTTTTCCAAATCACAAATA
AAGCCATCAGCAGTGCTCCCTTCCTGCTGTTCCAGCCACTGTGGACATTTGCCATCCTCATTTTCTTCTGGGTCC
TCTGGGTGGCTGTGCTGCTGAGCCTGGGAACTGCAGGAGCTGCCCAGGTTATGGAAGGCGGCCAAGTGGAATATA
AGCCCCTTTCGGGCATTCGGTACATGTGGTCGTACCATTTAATTGGCCTCATCTGGACTAGTGAATTCATCCTTG
CGTGCCAGCAAATGACTATAGCTGGGGCAGTGGTTACTTGTTATTTCAACAGAAGTAAAAATGATCCTCCTGATC
ATCCCATCCTTTCGTCTCTCTCCATTCTCTTCTTCTACCATCAAGGAACCGTTGTGAAAGGGTCATTTTTAATCT
CTGTGGTGAGGATTCCGAGAATCATTGTCATGTACATGCAAAACGCACTGAAAGAACAGCAGCATGGTGCATTGT
CCAGGTACCTGTTCCGATGCTGCTACTGCTGTTTCTGGTGTCTTGACAAATACCTGCTCCATCTCAACCAGAATG
CATATACTACAACTGCTATTAATGGGACAGATTTCTGTACATCAGCAAAAGATGCATTCAAAATCTTGTCCAAGA
ACTCAAGTCACTTTACATCTATTAACTGCTTTGGAGACTTCATAATTTTTCTAGGAAAGGTGTTAGTGGTGTGTT
TCACTGTTTTTGGAGGACTCATGGCTTTTAACTACAATCGGGCATTCCAGGTGTGGGCAGTCCCTCTGTTATTGG
TAGCTTTTTTTGCCTACTTAGTAGCCCATAGTTTTTTATCTGTGTTTGAAACTGTGCTGGATGCACTTTTCCTGT
GTTTTGCTGTTGATCTGGAAACAAATGATGGATCGTCAGAAAAGCCCTACTTTATGGATCAAGAATTTCTGAGTT
TCGTAAAAAGGAGCAACAAATTAAACAATGCAAGGGCACAGCAGGACAAGCACTCATTAAGGAATGAGGAGGGAA
CAGAACTCCAGGCCATTGTGAGATAGATACCCATTTAGGTATCTGTACCTGGAAAACATTTCCTTCTAAGAGCCA
TTTACAGAATAGAAGATGAGACCACTAGAGAAAAGTTAGTGAATTTTTTTTAAAAGACCTAATAAACCCTATTC
TTCCTCAAAA

FIGURE 148

MSGRDTILGLCILALALSLAMMFTFRFITTLLVHIFISLVILGLLFVCGVLWWLYYDYTNDLSIELDTERENMKC
VLGFAIVSTGITAVLLVLIFVLRKRIKLTVELFQITNKAISSAPFLLFQPLWTFAILIFFWVLWVAVLLSLGTAG
AAQVMEGGQVEYKPLSGIRYMWSYHLIGLIWTSEFILACQQMTIAGAVVTCYFNRSKNDPPDHPILSSLSILFFY
HQGTVVKGSFLISVVRIPRIIVMYMQNALKEQQHGALSRYLFRCCYCCFWCLDKYLLHLNQNAYTTTAINGTDFC
TSAKDAFKILSKNSSHFTSINCFGDFIIFLGKVLVVCFTVFGGLMAFNYNRAFQVWAVPLLLVAFFAYLVAHSFL
SVFETVLDALFLCFAVDLETNDGSSEKPYFMDQEFLSFVKRSNKLNNARAQQDKHSLRNEEGTELQAIVR

FIGURE 149

GTTCGATTAGCTCCTCTGAGAAGAAGAGAAAAGGTTCTTGGACCTCTCCCTGTTTCTTCCTTAGAATAATTTGTA
TGGGATTTGTGATGCAGGAAAGCCTAAGGGAAAAAGAATATTCATTCTGTGTGGTGAAAATTTTTTGAAAAAAAA
ATTGCCTTCTTCAAACAAGGGTGTCATTCTGATATTTATGAGGACTGTTGTTCTCACTATGAAGGCATCTGTTAT
TGAAATGTTCCTTGTTTTGCTGGTGACTGGAGTACATTCAAACAAAGAAACGGCAAAGAAGATTAAAAGGCCCAA
GTTCACTGTGCCTCAGATCAACTGCGATGTCAAAGCCGGAAAGATCATCGATCCTGAGTTCATTGTGAAATGTCC
AGCAGGATGCCAAGACCCCAAATACCATGTTTATGGCACTGACGTGTATGCATCCTACTCCAGTGTGTGTGGCGC
TGCCGTACACAGTGGTGTGCTTGATAATTCAGGAGGGAAAATACTTGTTCGGAAGGTTGCTGGACAGTCTGGTTA
CAAAGGGAGTTATTCCAACGGTGTCCAATCGTTATCCCTACCACGATGGAGAGAATCCTTTATCGTCTTAGAAAG
TAAACCCAAAAAGGGTGTAACCTACCCATCAGCTCTTACATACTCATCATCGAAAAGTCCAGCTGCCCAAGCAGG
TGAGACCACAAAAGCCTATCAGAGGCCACCTATTCCAGGGACAACTGCACAGCCGGTCACTCTGATGCAGCTTCT
GGCTGTCACTGTAGCTGTGGCCACCCCCACCACCTTGCCAAGGCCATCCCCTTCTGCTGCTTCTACCACCAGCAT
CCCCAGACCACAATCAGTGGGCCACAGGAGCCAGGAGATGGATCTCTGGTCCACTGCCACCTACACAAGCAGCCA
AAACAGGCCCAGAGCTGATCCAGGTATCCAAAGGCAAGATCCTTCAGGAGCTGCCTTCCAGAAACCTGTTGGAGC
GGATGTCAGCCTGGGACTTGTTCCAAAAGAAGAATTGAGCACACAGTCTTTGGAGCCAGTATCCCTGGGAGATCC
AAACTGCAAAATTGACTTGTCGTTTTTAATTGATGGGAGCACCAGCATTGGCAAACGGCGATTCCGAATCCAGAA
GCAGCTCCTGGCTGATGTTGCCCAAGCTCTTGACATTGGCCCTGCCGGTCCACTGATGGGTGTTGTCCAGTATGG
AGACAACCCTGCTACTCACTTTAACCTCAAGACACACACGAATTCTCGAGATCTGAAGACAGCCATAGAGAAAAT
TACTCAGAGAGGAGGACTTTCTAATGTAGGTCGGGCCATCTCCTTTGTGACCAAGAACTTCTTTTCCAAAGCCAA
TGGAAACAGAAGCGGGGCTCCCAATGTGGTGGTGGTGATGGTGGATGGCTGGCCCACGGACAAAGTGGAGGAGGC
TTCAAGACTTGCGAGAGAGTCAGGAATCAACATTTTCTTCATCACCATTGAAGGTGCTGCTGAAAATGAGAAGCA
GTATGTGGTGGAGCCCAACTTTGCAAACAAGGCCGTGTGCAGAACAAACGGCTTCTACTCGCTCCACGTGCAGAG
CTGGTTTGGCCTCCACAAGACCCTGCAGCCTCTGGTGAAGCGGGTCTGCGACACTGACCGCCTGGCCTGCAGCAA
GACCTGCTTGAACTCGGCTGACATTGGCTTCGTCATCGACGGCTCCAGCAGTGTGGGGACGGGCAACTTCCGCAC
CGTCCTCCAGTTTGTGACCAACCTCACCAAAGAGTTTGAGATTTCCGACACGGACACGCGCATCGGGGCCGTGCA
GTACACCTACGAACAGCGGCTGGAGTTTGGGTTCGACAAGTACAGCAGCAAGCCTGACATCCTCAACGCCATCAA
GAGGGTGGGCTACTGGAGTGGTGGCACCAGCACGGGGGCTGCCATCAACTTCGCCCTGGAGCAGCTCTTCAAGAA
GTCCAAGCCCAACAAGAGGAAGTTAATGATCCTCATCACCGACGGGAGGTCCTACGACGACGTCCGGATCCCAGC
CATGGCTGCCCATCTGAAGGGAGTGATCACCTATGCGATAGGCGTTGCCTGGGCTGCCCAAGAGGAGCTAGAAGT
CATTGCCACTCACCCCGCCAGAGACCACTCCTTCTTTGTGGACGAGTTTGACAACCTCCATCAGTATGTCCCCAG
GATCATCCAGAACATTTGTACAGAGTTCAACTCACAGCCTCGGAACTGAATTCAGAGCAGGCAGAGCACCAGCAA
GTGCTGCTTTACTAACTGACGTGTTGGACCACCCCACCGCTTAATGGGGCACGCACGGTGCATCAAGTCTTGGGC
AGGGCATGGAGAAACAAATGTCTTGTTATTATTCTTTGCCATCATGCTTTTTCATATTCCAAAACTTGGAGTTAC
AAAGATGATCACAAACGTATAGAATGAGCCAAAAGGCTACATCATGTTGAGGGTGCTGGAGATTTTACATTTTGA
CAATTGTTTTCAAAATAAATGTTCGGAATACAGTGCAGCCCTTACGACAGGCTTACGTAGAGCTTTTGTGAGATT
TTTAAGTTGTTATTTCTGATTTGAACTCTGTAACCCTCAGCAAGTTTCATTTTTGTCATGACAATGTAGGAATTG
CTGAATTAAATGTTTAGAAGGATGAAAAATAAAAAAAAAAAAAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAAAAAAAAAAAAAAG

FIGURE 150

MRTVVLTMKASVIEMFLVLLVTGVHSNKETAKKIKRPKFTVPQINCDVKAGKIIDPEFIVKCPAGCQDPKYHVYG
TDVYASYSSVCGAAVHSGVLDNSGGKILVRKVAGQSGYKGSYSNGVQSLSLPRWRESFIVLESKPKKGVTYPSAL
TYSSSKSPAAQAGETTKAYQRPPIPGTTAQPVTLMQLLAVTVAVATPTTLPRPSPSAASTTSIPRPQSVGHRSQE
MDLWSTATYTSSQNRPRADPGIQRQDPSGAAFQKPVGADVSLGLVPKEELSTQSLEPVSLGDPNCKIDLSFLIDG
STSIGKRRFRIQKQLLADVAQALDIGPAGPLMGVVQYGDNPATHFNLKTHTNSRDLKTAIEKITQRGGLSNVGRA
ISFVTKNFFSKANGNRSGAPNVVVVMVDGWPTDKVEEASRLARESGINIFFITIEGAAENEKQYVVEPNFANKAV
CRTNGFYSLHVQSWFGLHKTLQPLVKRVCDTDRLACSKTCLNSADIGFVIDGSSSVGTGNFRTVLQFVTNLTKEF
EISDTDTRIGAVQYTYEQRLEFGFDKYSSKPDILNAIKRVGYWSGGTSTGAAINFALEQLFKKSKPNKRKLMILI
TDGRSYDDVRIPAMAAHLKGVITYAIGVAWAAQEELEVIATHPARDHSFFVDEFDNLHQYVPRIIQNICTEFNSQPRN

FIGURE 151

CAGGATGAACTGGTTGCAGTGGCTGCTGCTGCTGCGGGGGCGCTGAGAGGACACGAGCTCTATGCCTTTCCGGCT
GCTCATCCCGCTCGGCCTCCTGTGCGCGCTGCTGCCTCAGCACCATGGTGCGCCAGGTCCCGACGGCTCCGCGCC
AGATCCCGCCCACTACAGTTTTTCTCTGACTCTAATTGATGCACTGGACACCTTGCTGATTTTGGGGAATGTCTC
AGAATTCCAAAGAGTGGTTGAAGTGCTCCAGGACAGCGTGGACTTTGATATTGATGTGAACGCCTCTGTGTTTGA
AACAAACATTCGAGTGGTAGGAGGACTCCTGTCTGCTCATCTGCTCTCCAAGAAGGCTGGGGTGGAAGTAGAGGC
TGGATGGCCCTGTTCCGGGCCTCTCCTGAGAATGGCTGAGGAGGCGGCCCGAAAACTCCTCCCAGCCTTTCAGAC
CCCCACTGGCATGCCATATGGAACAGTGAACTTACTTCATGGCGTGAACCCAGGAGAGACCCCTGTCACCTGTAC
GGCAGGGATTGGGACCTTCATTGTTGAATTTGCCACCCTGAGCAGCCTCACTGGTGACCCGGTGTTCGAAGATGT
GGCCAGAGTGGCTTTGATGCGCCTCTGGGAGAGCCGGTCAGATATCGGGCTGGTCGGCAACCACATTGATGTGCT
CACTGGCAAGTGGGTGGCCCAGGACGCAGGCATCGGGGCTGGCGTGGACTCCTACTTTGAGTACTTGGTGAAAGG
AGCCATCCTGCTTCAGGATAAGAAGCTCATGGCCATGTTCCTAGAGTATAACAAAGCCATCCGGAACTACACCCG
CTTCGATGACTGGTACCTGTGGGTTCAGATGTACAAGGGGACTGTGTCCATGCCAGTCTTCCAGTCCTTGGAGGC
CTACTGGCCTGGTCTTCAGAGCCTCATTGGAGACATTGACAATGCCATGAGGACCTTCCTCAACTACTACACTGT
ATGGAAGCAGTTTGGGGGGCTCCCGGAATTCTACAACATTCCTCAGGGATACACAGTGGAGAAGCGAGAGGGCTA
CCCACTTCGGCCAGAACTTATTGAAAGCGCAATGTACCTCTACCGTGCCACGGGGGATCCCACCCTCCTAGAACT
CGGAAGAGATGCTGTGGAATCCATTGAAAAAATCAGCAAGGTGGAGTGCGGATTTGCAACAATCAAAGATCTGCG
AGACCACAAGCTGGACAACCGCATGGAGTCGTTCTTCCTGGCCGAGACTGTGAAATACCTCTACCTCCTGTTTGA
CCCAACCAACTTCATCCACAACAATGGGTCCACCTTCGACGCGGTGATCACCCCCTATGGGGAGTGCATCCTGGG
GGCTGGGGGGTACATCTTCAACACAGAAGCTCACCCCATCGACCTTGCCGCCCTGCACTGCTGCCAGAGGCTGAA
GGAAGAGCAGTGGGAGGTGGAGGACTTGATGAGGGAATTCTACTCTCTCAAACGGAGCAGGTCGAAATTTCAGAA
AAACACTGTTAGTTCGGGGCCATGGGAACCTCCAGCAAGGCCAGGAACACTCTTCTCACCAGAAAACCATGACCA
GGCAAGGGAGAGGAAGCCTGCCAAACAGAAGGTCCCACTTCTCAGCTGCCCCAGTCAGCCCTTCACCTCCAAGTT
GGCATTACTGGGACAGGTTTTCCTAGACTCCTCATAACCACTGGATAATTTTTTATTTTTATTTTTTTGAGGCT
AAACTATAATAAATTGCTTTTGGCTATCATAAAA

FIGURE 152

MPFRLLIPLGLLCALLPQHHGAPGPDGSAPDPAHYSFSLTLIDALDTLLILGNVSEFQRVVEVLQDSVDFDIDVN
ASVFETNIRVVGGLLSAHLLSKKAGVEVEAGWPCSGPLLRMAEEAARKLLPAFQTPTGMPYGTVNLLHGVNPGET
PVTCTAGIGTFIVEFATLSSLTGDPVFEDVARVALMRLWESRSDIGLVGNHIDVLTGKWVAQDAGIGAGVDSYFE
YLVKGAILLQDKKLMAMFLEYNKAIRNYTRFDDWYLWVQMYKGTVSMPVFQSLEAYWPGLQSLIGDIDNAMRTFL
NYYTVWKQFGGLPEFYNIPQGYTVEKREGYPLRPELIESAMYLYRATGDPTLLELGRDAVESIEKISKVECGFAT
IKDLRDHKLDNRMESFFLAETVKYLYLLFDPTNFIHNNGSTFDAVITPYGECILGAGGYIFNTEAHPIDLAALHC
CQRLKEEQWEVEDLMREFYSLKRSRSKFQKNTVSSGPWEPPARPGTLFSPENHDQARERKPAKQKVPLLSCPSQP
FTSKLALLGQVFLDSS

FIGURE 153

CGGACGCGTGGGCGGACGCGTGGGCGGACGCGTGGGTTGGGAGGGGGCAGGATGGGAGGGAAAGTGAAGAAAACA
GAAAAGGAGAGGGACAGAGGCCAGAGGACTTCTCATACTGGACAGAAACCGATCAGGCATGGAACTCCCCTTCGT
CACTCACCTGTTCTTGCCCCTGGTGTTCCTGACAGGTCTCTGCTCCCCCTTTAACCTGGATGAACATCACCCACG
CCTATTCCCAGGGCCACCAGAAGCTGAATTTGGATACAGTGTCTTACAACATGTTGGGGGTGGACAGCGATGGAT
GCTGGTGGGCGCCCCCTGGGATGGGCCTTCAGGCGACCGGAGGGGGGACGTTTATCGCTGCCCTGTAGGGGGGC
CCACAATGCCCCATGTGCCAAGGGCCACTTAGGTGACTACCAACTGGGAAATTCATCTCATCCTGCTGTGAATAT
GCACCTGGGGATGTCTCTGTTAGAGACAGATGGTGATGGGGGATTCATGGTGAGCTAAGGAGAGGGTGGTGGCAG
TGTCTCTGAAGGTCCATAAAAGAAAAAAGAGAAGTGTGGTAAGGGAAAATGGTCTGTGTGGAGGGGTCAAGGAGT
TAAAAACCCTAGAAAGCAAAAGGTAGGTAATGTCAGGGAGTAGTCTTCATGCCTCCTTCAACTGGGAGCATGTTC
TGAGGGTGCCCTCCCAAGCCTGGGAGTAACTATTTCCCCCATCCCCAGGCCTGTGCCCCTCTCTGGTCTCGTGCT
TGTGGCAGCTCTGTCTTCAGTTCTGGGATATGTGCCCGTGTGGATGCTTCATTCCAGCCTCAGGGAAGCCTGGCA
CCCACTGCCCAACGTGAGCCAGAGGAAGGCTGAGTACTTGGTTCCCAGAAGGAGATACTGGGTGGGAAAAAGATG
GGGCAAAGCGGTATGATGCCTGGCAAAGGGCCTGCATGGCTATCCTCATTGCTACCTAATGTGCTTGCAAAAGCT
CCATGTTTCCTAACAGATTCAGACTCCTGGCCAGGTGTGGTGGCCCACACCTGTAATTCTAGCACTTTGGGAGGC
CAAGGTGGGCAGATCACTTGAGGTCAGGAGTTCAAGACCAGCCTGGCCAACATGGTGAAACTCCATCTCTACTAA
AAAAAAAAAAATACAAAAATTAGCTGGGTGCGCTAGTGCATGCCTGTAATCTCATCTACTCGGGAGGCTAAGACA
GGAGACTCTCACTTCAACCCAGGAGGTGGAGGTTGCGGTGAGCCAAGATTGTGCCTCTGCACTCTAGCGTGGGTG
ACAGAGTAAGCGAGACTCCATCTCAAAAATAATAATAATAATAATTCAGACTCCTTATCAGGAGTCCATGATCTG
GCCTGGCACAGTAACTCATGCCTGTAATCCCAACATTTTGGGAGGCCAACGCAGGAGGATTGCTTGAGGTCTGGA
GGTTTGAGACCAGCCTGGGCAACATAGAAAGACCCCATCTCTAAATAAATGTTTTAAAAAT

FIGURE 154

></usr/seqdb2/sst/DNA/Dnaseqs.min/ss.DNA57039
><subunit 1 of 1, 124 aa, 1 stop
><MW: 13352, pI: 5.99, NX(S/T): 1
MELPFVTHLFLPLVFLTGLCSPFNLDEHHPRLFPGPPEAEFGYSVLQHVGGGQRWMLVGAPWDGPSGDRRGDVYR
CPVGGAHNAPCAKGHLGDYQLGNSSHPAVNMHLGMSLLETDGDGGFMVS

Important features:
Signal peptide:
amino acids 1-22

Cell attachment sequence.
amino acids 70-73

N-glycosylation site.
amino acids 98-101

Integrins alpha chain proteins
amino acids 67-81

FIGURE 155

GCGAGCTCCGGGTGCTGTGGCCCGGCCTTGGCGGGGCGGCCTCCGGCTCAGGCTGGCTGAGAGGCTCCCAGCTGC
AGCGTCCCCGCCCGCCTCCTCGGGAGCTCTGATCTCAGCTGACAGTGCCCTCGGGGACCAAACAAGCCTGGCAGG
GTCTCACTTTGTTGCCCAGGCTGGAGTTCAGTGCCATGATCATGGTTTACTGCAGCCTTGACCTCCTGGGTTCAA
GCGATCCTGCTGAGTAGCTGGGACTACAGGACAAAATTAGAAGATCAAA<u>ATG</u>GAAAATATGCTGCTTTGGTTGAT
ATTTTTCACCCCTGGGTGGACCCTCATTGATGGATCTGAAATGGAATGGGATTTTATGTGGCACTTGAGAAAGGT
ACCCCGGATTGTCAGTGAAAGGACTTTCCATCTCACCAGCCCCGCATTTGAGGCAGATGCTAAGATGATGGTAAA
TACAGTGTGTGGCATCGAATGCCAGAAAGAACTCCCAACTCCCAGCCTTTCTGAATTGGAGGATTATCTTTCCTA
TGAGACTGTCTTTGAGAATGGCACCCGAACCTTAACCAGGGTGAAAGTTCAAGATTTGGTTCTTGAGCCGACTCA
AAATATCACCACAAAGGGAGTATCTGTTAGGAGAAAGAGACAGGTGTATGGCACCGACAGCAGGTTCAGCATCTT
GGACAAAAGGTTCTTAACCAATTTCCCTTTCAGCACAGCTGTGAAGCTTTCCACGGGCTGTAGTGGCATTCTCAT
TTCCCCTCAGCATGTTCTAACTGCTGCCCACTGTGTTCATGATGGAAAGGACTATGTCAAAGGGAGTAAAAAGCT
AAGGGTAGGGTTGTTGAAGATGAGGAATAAAAGTGGAGGCAAGAAACGTCGAGGTTCTAAGAGGAGCAGGAGAGA
AGCTAGTGGTGGTGACCAAAGAGAGGGTACCAGAGAGCATCTGCAGGAGAGAGCGAAGGGTGGGAGAAGAAGAAA
AAAATCTGGCCGGGGTCAGAGGATTGCCGAAGGGAGGCCTTCCTTTCAGTGGACCCGGGTCAAGAATACCCACAT
TCCGAAGGGCTGGGCACGAGGAGGCATGGGGGACGCTACCTTGGACTATGACTATGCTCTTCTGGAGCTGAAGCG
TGCTCACAAAAAGAAATACATGGAACTTGGAATCAGCCCAACGATCAAGAAAATGCCTGGTGGAATGATCCACTT
CTCAGGATTTGATAACGATAGGGCTGATCAGTTGGTCTATCGGTTTTGCAGTGTGTCCGACGAATCCAATGATCT
CCTTTACCAATACTGCGATGCTGAGTCGGGCTCCACCGGTTCGGGGGTCTATCTGCGTCTGAAAGATCCAGACAA
AAAGAATTGGAAGCGCAAAATCATTGCGGTCTACTCAGGGCACCAGTGGGTGGATGTCCACGGGGTTCAGAAGGA
CTACAACGTTGCTGTTCGCATCACTCCCCTAAAATACGCCCAGATTTGCCTCTGGATTCACGGGAACGATGCCAA
TTGTGCTTACGGC<u>TAA</u>CAGAGACCTGAAACAGGGCGGTGTATCATCTAAATCACAGAGAAAACCAGCTCTGCTTA
CCGTAGTGAGATCACTTCATAGGTTATGCCTGGACTTGAACTCTGTCAATAGCATTTCAACATTTTTCAAAATCA
GGAGATTTTCGTCCATTTAAAAAATGTATAGGTGCAGATATTGAAACTAGGTGGGCACTTCAATGCCAAGTATAT
ACTCTTCTTTACATGGTGATGAGTTTCATTTGTAGAAAAATTTTGTTGCCTTCTTAAAAATTAGACACACTTTAA
ACCTTCAAACAGGTATTATAAATAACATGTGACTCCTTAATGGACTTATTCTCAGGGTCCTACTCTAAGAAGAAT
CTAATAGGATGCTGGTTGTGTATTAAATGTGAAATTGCATAGATAAAGGTAGATGGTAAAGCAATTAGTATCAGA
ATAGAGACAGAAAGTTACAACACAGTTTGTACTACTCTGAGATGGATCCATTCAGCTCATGCCCTCAATGTTTAT
ATTGTGTTATCTGTTGGGTCTGGGACATTTAGTTTAGTTTTTTTGAAGAATTACAAATCAGAAGAAAAAGCAAGC
ATTATAAACAAAACTAATAACTGTTTTACTGCTTTAAGAAATAACAATTACAATGTGTATTATTTAAAAATGGGA
GAAATAGTTTGTTCTATGAAATAAACCTAGTTTAGAAATAGGGAAGCTGAGACATTTTAAGATCTCAAGTTTTTA
TTTAACTAATACTCAAAATATGGACTTTTCATGTATGCATAGGGAAGACACTTCACAAATTATGAATGATCATGT
GTTGAAAGCCACATTATTTTATGCTATACATTCTATGTATGAGGTGCTACATTTTTAGGACAAAGAATTCTGTAA
TCTTTTTCAAGAAAGAGTCTTTTTCTCCTTGACAAAATCCAGCTTTTGTATGAGGACTATAGGGTGAATTCTCTG
ATTAGTAATTTTAGATATGTCCTTTCCTAAAAATGAATAAAATTTATGAATATGA

FIGURE 156

</usr/seqdb2/sst/DNA/Dnaseqs.min/ss.DNA57253
<subunit 1 of 1, 413 aa, 1 stop
<MW: 47070, pI: 9.92, NX(S/T): 3
MENMLLWLIFFTPGWTLIDGSEMEWDFMWHLRKVPRIVSERTFHLTSPAFEADAKMMVNTVCGIECQKELPTPSL
SELEDYLSYETVFENGTRTLTRVKVQDLVLEPTQNITTKGVSVRRKRQVYGTDSRFSILDKRFLTNFPFSTAVKL
STGCSGILISPQHVLTAAHCVHDGKDYVKGSKKLRVGLLKMRNKSGGKKRRGSKRSRREASGGDQREGTREHLQE
RAKGGRRRKKSGRGQRIAEGRPSFQWTRVKNTHIPKGWARGGMGDATLDYDYALLELKRAHKKKYMELGISPTIK
KMPGGMIHFSGFDNDRADQLVYRFCSVSDESNDLLYQYCDAESGSTGSGVYLRLKDPDKKNWKRKIIAVYSGHQW
VDVHGVQKDYNVAVRITPLKYAQICLWIHGNDANCAYG

Important features:
Signal peptide:
amino acids 1-16

N-glycosylation sites.
amino acids 90-93, 110-113 and 193-196

Glycosaminoglycan attachment site.
amino acids 236-239

Serine proteases, trypsin family, histidine active site.
amino acids 165-170

FIGURE 157

GGGACCCATGCGGCCGTGACCCCCGGCTCCCTAGAGGCCCAGCGCAGCCGCAGCGGACAAAGGAGCATGTCCGCG
CCGGGGAAGGCCCGTCCTCCGGCCGCCATAAGGCTCCGGTCGCCGCTGGGCCCGCGCCGCGCTCCTGCCCGCCCG
GGCTCCGGGGCGGCCCGCTAGGCCAGTGCGCCGCCGCTCGCCCCGCAGGCCCCGGCCCGCAGCATGGAGCCACCC
GGACGCCGGCGGGGCCGCGCGCAGCCGCCGCTGTTGCTGCCGCTCTCGCTGTTAGCGCTGCTCGCGCTGCTGGGA
GGCGGCGGCGGCGGCGGCGCCGCGGCGCTGCCCGCCGGCTGCAAGCACGATGGGCGGCCCCGAGGGGCTGGCAGG
GCGGCGGGCGCCGCCGAGGGCAAGGTGGTGTGCAGCAGCCTGGAACTCGCGCAGGTCCTGCCCCCAGATACTCTG
CCCAACCGCACGGTCACCCTGATTCTGAGTAACAATAAGATATCCGAGCTGAAGAATGGCTCATTTTCTGGGTTA
AGTCTCCTTGAAAGATTGGACCTCCGAAACAATCTTATTAGTAGTATAGATCCAGGTGCCTTCTGGGGACTGTCA
TCTCTAAAAAGATTGGATCTGACAAACAATCGAATAGGATGTCTGAATGCAGACATATTTCGAGGACTCACCAAT
CTGGTTCGGCTAAACCTTTCGGGGAATTTGTTTTCTTCATTATCTCAAGGAACTTTTGATTATCTTGCGTCATTA
CGGTCTTTGGAATTCCAGACTGAGTATCTTTTGTGTGACTGTAACATACTGTGGATGCATCGCTGGGTAAAGGAG
AAGAACATCACGGTACGGGATACCAGGTGTGTTTATCCTAAGTCACTGCAGGCCCAACCAGTCACAGGCGTGAAG
CAGGAGCTGTTGACATGCGACCCTCCGCTTGAATTGCCGTCTTTCTACATGACTCCATCTCATCGCCAAGTTGTG
TTTGAAGGAGACAGCCTTCCTTTCCAGTGCATGGCTTCATATATTGATCAGGACATGCAAGTGTTGTGGTATCAG
GATGGGAGAATAGTTGAAACCGATGAATCGCAAGGTATTTTTGTTGAAAAGAACATGATTCACAACTGCTCCTTG
ATTGCAAGTGCCCTAACCATTTCTAATATTCAGGCTGGATCTACTGGAAATTGGGGCTGTCATGTCCAGACCAAA
CGTGGGAATAATACGAGGACTGTGGATATTGTGGTATTAGAGAGTTCTGCACAGTACTGTCCTCCAGAGAGGGTG
GTAAACAACAAAGGTGACTTCAGATGGCCCAGAACATTGGCAGGCATTACTGCATATCTGCAGTGTACGCGGAAC
ACCCATGGCAGTGGGATATATCCCGGAAACCCACAGGATGAGAGAAAAGCTTGGCGCAGATGTGATAGAGGTGGC
TTTTGGGCAGATGATGATTATTCTCGCTGTCAGTATGCAAATGATGTCACTAGAGTTCTTTATATGTTTAATCAG
ATGCCCCTCAATCTTACCAATGCCGTGGCAACAGCTCGACAGTTACTGGCTTACACTGTGGAAGCAGCCAACTTT
TCTGACAAAATGGATGTTATATTTGTGGCAGAAATGATTGAAAAATTTGGAAGATTTACCAAGGAGGAAAAATCA
AAAGAGCTAGGTGACGTGATGGTTGACATTGCAAGTAACATCATGTTGGCTGATGAACGTGTCCTGTGGCTGGCG
CAGAGGGAAGCTAAAGCCTGCAGTAGGATTGTGCAGTGTCTTCAGCGCATTGCTACCTACCGGCTAGCCGGTGGA
GCTCACGTTTATTCAACATATTCACCCAATATTGCTCTGGAAGCTTATGTCATCAAGTCTACTGGCTTCACGGGG
ATGACCTGTACCGTGTTCCAGAAAGTGGCAGCCTCTGATCGTACAGGACTTTCGGATTATGGGAGGCGGGATCCA
GAGGGAAACCTGGATAAGCAGCTGAGCTTTAAGTGCAATGTTTCAAATACATTTTCGAGTCTGGCACTAAAGGTA
TGTTACATTCTGCAATCATTTAAGACTATTTACAGTTAAATTAGAATGCTCCAAATGTTCTGCTTCGCAAAATAA
CCTTATTAAAAGATTTTTTTTTGCAGGAAGATAGGTATTATTGCTTTTGCTACTGTTTTAAAGAAAACTAACCAG
GAAGAACTGCATTACGACTTTCAAGGGCCCTAGGCATTTTTGCCTTTGATTCCCTTTCTTCACATAAAAATATCA
GAAATTACATTTTATAACTGCAGTGGTATAAATGCAAATATACTATTGTTACATGTGAAAAAATTTATTTGACT
TAAAAGTTTATTTATTTGTTTTTTTGCTCCTGATTTTAAGACAATAAGATGTTTTCATGGCCCCTAAAAGTATC
ATGAGCCTTTGGCACTGCGCCTGCCAAGCCTAGTGGAGAAGTCAACCCTGAGACCAGGTGTTTAATCAAGCAAGC
TGTATATCAAAATTTTTGGCAGAAAACACAAATATGTCATATATCTTTTTTTAAAAAAAGTATTTCATTGAAGCA
AGCAAAATGAAAGCATTTTTACTGATTTTTAAAATTGGTGCTTTAGATATATTTGACTACACTGTATTGAAGCAA
ATAGAGGAGGCACAACTCCAGCACCCTAATGGAACCACATTTTTTTCACTTAGCTTTCTGTGGGCATGTGTAATT
GTATTCTCTGCGGTTTTTAATCTCACAGTACTTTATTTCTGTCTTGTCCCTCAATAATATCACAAACAATATTCC
AGTCATTTTAATGGCTGCATAATAACTGATCCAACAGGTGTTAGGTGTTCTGGTTTAGTGTGAGCACTCAATAAA
TATTGAATGAATGAACGAAAAAAAAAAAAAAAA

FIGURE 158

MEPPGRRRGRAQPPLLLPLSLLALLALLGGGGGGGAAALPAGCKHDGRPRGAGRAAGAAEGKVVCSSLELAQVLP
PDTLPNRTVTLILSNNKISELKNGSFSGLSLLERLDLRNNLISSIDPGAFWGLSSLKRLDLTNNRIGCLNADIFR
GLTNLVRLNLSGNLFSSLSQGTFDYLASLRSLEFQTEYLLCDCNILWMHRWVKEKNITVRDTRCVYPKSLQAQPV
TGVKQELLTCDPPLELPSFYMTPSHRQVVFEGDSLPFQCMASYIDQDMQVLWYQDGRIVETDESQGIFVEKNMIH
NCSLIASALTISNIQAGSTGNWGCHVQTKRGNNTRTVDIVVLESSAQYCPPERVVNNKGDFRWPRTLAGITAYLQ
CTRNTHGSGIYPGNPQDERKAWRRCDRGGFWADDDYSRCQYANDVTRVLYMFNQMPLNLTNAVATARQLLAYTVE
AANFSDKMDVIFVAEMIEKFGRFTKEEKSKELGDVMVDIASNIMLADERVLWLAQREAKACSRIVQCLQRIATYR
LAGGAHVYSTYSPNIALEAYVIKSTGFTGMTCTVFQKVAASDRTGLSDYGRRDPEGNLDKQLSFKCNVSNTFSSL
ALKVCYILQSFKTIYS

Signal peptide:
amino acids 1-33

Transmembrane domain:
amino acids 13-40 (type II)

N-glycosylation site.
amino acids 81-85, 98-102, 159-163, 206-210, 301-305, 332-336, 433-437, 453-457, 592-596

N-myristoylation site.
amino acids 29-35, 30-36, 31-37, 32-38, 33-39, 34-40, 51-57, 57-63, 99-105, 123-129, 142-148, 162-168, 317-323, 320-326, 384-390, 403-409, 554-560

FIGURE 159

GGGGAATCTGCAGTAGGTCTGCCGGCGATGGAGTGGTGGGCTAGCTCGCCGCTTCGGCTCTGGCTGCTGTTGTTC
CTCCTGCCCTCAGCGCAGGGCCGCCAGAAGGAGTCAGGTTCAAAATGGAAAGTATTTATTGACCAAATTAACAGG
TCTTTGGAGAATTACGAACCATGTTCAAGTCAAAACTGCAGCTGCTACCATGGTGTCATAGAAGAGGATCTAACT
CCTTTCCGAGGAGGCATCTCCAGGAAGATGATGGCAGAGGTAGTCAGACGGAAGCTAGGGACCCACTATCAGATC
ACTAAGAACAGACTGTACCGGGAAAATGACTGCATGTTCCCCTCAAGGTGTAGTGGTGTTGAGCACTTTATTTTG
GAAGTGATCGGGCGTCTCCCTGACATGGAGATGGTGATCAATGTACGAGATTATCCTCAGGTTCCTAAATGGATG
GAGCCTGCCATCCCAGTCTTCTCCTTCAGTAAGACATCAGAGTACCATGATATCATGTATCCTGCTTGGACATTT
TGGGAAGGGGGACCTGCTGTTTGGCCAATTTATCCTACAGGTCTTGGACGGTGGGACCTCTTCAGAGAAGATCTG
GTAAGGTCAGCAGCACAGTGGCCATGGAAAAAGAAAAACTCTACAGCATATTTCCGAGGATCAAGGACAAGTCCA
GAACGAGATCCTCTCATTCTTCTGTCTCGGAAAAACCCAAAACTTGTTGATGCAGAATACACCAAAAACCAGGCC
TGGAAATCTATGAAAGATACCTTAGGAAAGCCAGCTGCTAAGGATGTCCATCTTGTGGATCACTGCAAATACAAG
TATCTGTTTAATTTTCGAGGCGTAGCTGCAAGTTTCCGGTTTAAACACCTCTTCCTGTGTGGCTCACTTGTTTTC
CATGTTGGTGATGAGTGGCTAGAATTCTTCTATCCACAGCTGAAGCCATGGGTTCACTATATCCCAGTCAAAACA
GATCTCTCCAATGTCCAAGAGCTGTTACAATTTGTAAAAGCAAATGATGATGTAGCTCAAGAGATTGCTGAAAGG
GGAAGCCAGTTTATTAGGAACCATTTGCAGATGGATGACATCACCTGTTACTGGGAGAACCTCTTGAGTGAATAC
TCTAAATTCCTGTCTTATAATGTAACGAGAAGGAAAGGTTATGATCAAATTATTCCCAAAATGTTGAAAACTGAA
CTATAGTAGTCATCATAGGACCATAGTCCTCTTTGTGGCAACAGATCTCAGATATCCTACGGTGAGAAGCTTACC
ATAAGCTTGGCTCCTATACCTTGAATATCTGCTATCAAGCCAAATACCTGGTTTTCCTTATCATGCTGCACCCAG
AGCAACTCTTGAGAAAGATTTAAAATGTGTCTAATACACTGATATGAAGCAGTTCAACTTTTTGGATGAATAAGG
ACCAGAAATCGTGAGATGTGGATTTTGAACCCAACTCTACCTTTCATTTTCTTAAGACCAATCACAGCTTGTGCC
TCAGATCATCCACCTGTGTGAGTCCATCACTGTGAAATTGACTGTGTCCATGTGATGATGCCCTTTGTCCCATTA
TTTGGAGCAGAAAATTCGTCATTTGGAAGTAGTACAACTCATTGCTGGAATTGTGAAATTATTCAAGGCGTGATC
TCTGTCACTTTATTTTAATGTAGGAAACCCTATGGGGTTTATGAAAAATACTTGGGGATCATTCTCTGAATGGTC
TAAGGAAGCGGTAGCCATGCCATGCAATGATGTAGGAGTTCTCTTTTGTAAAACCATAAACTCTGTTACTCAGGA
GGTTTCTATAATGCCACATAGAAAGAGGCCAATTGCATGAGTAATTATTGCAATTGGATTTCAGGTTCCCTTTTT
GTGCCTTCATGCCCTACTTCTTAATGCCTCTCTAAAGCCAAA

FIGURE 160

MEWWASSPLRLWLLLFLLPSAQGRQKESGSKWKVFIDQINRSLENYEPCSSQNCSCYHGVIEEDLTPFRGGISRK
MMAEVVRRKLGTHYQITKNRLYRENDCMFPSRCSGVEHFILEVIGRLPDMEMVINVRDYPQVPKWMEPAIPVFSF
SKTSEYHDIMYPAWTFWEGGPAVWPIYPTGLGRWDLFREDLVRSAAQWPWKKKNSTAYFRGSRTSPERDPLILLS
RKNPKLVDAEYTKNQAWKSMKDTLGKPAAKDVHLVDHCKYKYLFNFRGVAASFRFKHLFLCGSLVFHVGDEWLEF
FYPQLKPWVHYIPVKTDLSNVQELLQFVKANDDVAQEIAERGSQFIRNHLQMDDITCYWENLLSEYSKFLSYNVT
RRKGYDQIIPKMLKTEL

FIGURE 161

CCGAGCACAGGAGATTGCCTGCGTTTAGGAGGTGGCTGCGTTGTGGGAAAAGCTATCAAGGAAGAAATTGCCAAA
CCATGTCTTTTTTTCTGTTTTCAGAGTAGTTCACAACAGATCTGAGTGTTTTAATTAAGCATGGAATACAGAAAA
CAACAAAAAACTTAAGCTTTAATTTCATCTGGAATTCCACAGTTTTCTTAGCTCCCTGGACCCGGTTGACCTGTT
GGCTCTTCCCGCTGGCTGCTCTATCACGTGGTGCTCTCCGACTACTCACCCCGAGTGTAAAGAACCTTCGGCTCG
CGTGCTTCTGAGCTGCTGTGGATGGCCTCGGCTCTCTGGACTGTCCTTCCGAGTAGGATGTCACTGAGATCCCTC
AAATGGAGCCTCCTGCTGCTGTCACTCCTGAGTTTCTTTGTGATGTGGTACCTCAGCCTTCCCCACTACAATGTG
ATAGAACGCGTGAACTGGATGTACTTCTATGAGTATGAGCCGATTTACAGACAAGACTTTCACTTCACACTTCGA
GAGCATTCAAACTGCTCTCATCAAAATCCATTTCTGGTCATTCTGGTGACCTCCCACCCTTCAGATGTGAAAGCC
AGGCAGGCCATTAGAGTTACTTGGGGTGAAAAAAAGTCTTGGTGGGGATATGAGGTTCTTACATTTTTCTTATTA
GGCCAAGAGGCTGAAAAGGAAGACAAAATGTTGGCATTGTCCTTAGAGGATGAACACCTTCTTTATGGTGACATA
ATCCGACAAGATTTTTTAGACACATATAATAACCTGACCTTGAAAACCATTATGGCATTCAGGTGGGTAACTGAG
TTTTGCCCCAATGCCAAGTACGTAATGAAGACAGACACTGATGTTTTCATCAATACTGGCAATTTAGTGAAGTAT
CTTTTAAACCTAAACCACTCAGAGAAGTTTTTCACAGGTTATCCTCTAATTGATAATTATTCCTATAGAGGATTT
TACCAAAAAACCCATATTTCTTACCAGGAGTATCCTTTCAAGGTGTTCCCTCCATACTGCAGTGGGTTGGGTTAT
ATAATGTCCAGAGATTTGGTGCCAAGGATCTATGAAATGATGGGTCACGTAAAACCCATCAAGTTTGAAGATGTT
TATGTCGGGATCTGTTTGAATTTATTAAAAGTGAACATTCATATTCCAGAAGACACAAATCTTTTCTTTCTATAT
AGAATCCATTTGGATGTCTGTCAACTGAGACGTGTGATTGCAGCCCATGGCTTTTCTTCCAAGGAGATCATCACT
TTTTGGCAGGTCATGCTAAGGAACACCACATGCCATTATTAACTTCACATTCTACAAAAAGCCTAGAAGGACAGG
ATACCTTGTGGAAAGTGTTAAATAAAGTAGGTACTGTGGAAAATTCATGGGGAGGTCAGTGTGCTGGCTTACACT
GAACTGAAACTCATGAAAAACCCAGACTGGAGACTGGAGGGTTACACTTGTGATTTATTAGTCAGGCCCTTCAAA
GATGATATGTGGAGGAATTAAATATAAAGGAATTGGAGGTTTTTGCTAAAGAAATTAATAGGACCAAACAATTTG
GACATGTCATTCTGTAGACTAGAATTTCTTAAAAGGGTGTTACTGAGTTATAAGCTCACTAGGCTGTAAAAACAA
AACAATGTAGAGTTTTATTTATTGAACAATGTAGTCACTTGAAGGTTTTGTGTATATCTTATGTGGATTACCAAT
TTAAAAATATATGTAGTTCTGTGTCAAAAAACTTCTTCACTGAAGTTATACTGAACAAAATTTTACCTGTTTTTG
GTCATTTATAAAGTACTTCAAGATGTTGCAGTATTTCACAGTTATTATTATTTAAAATTACTTCAACTTTGTGTT
TTTAAATGTTTTGACGATTTCAATACAAGATAAAAAGGATAGTGAATCATTCTTTACATGCAAACATTTTCCAGT
TACTTAACTGATCAGTTTATTATTGATACATCACTCCATTAATGTAAAGTCATAGGTCATTATTGCATATCAGTA
ATCTCTTGGACTTTGTTAAATATTTTACTGTGGTAATATAGAGAAGAATTAAAGCAAGAAAATCTGAAAA

FIGURE 162

MASALWTVLPSRMSLRSLKWSLLLLSLLSFFVMWYLSLPHYNVIERVNWMYFYEYEPIYRQDFHFTLREHSNCSH
QNPFLVILVTSHPSDVKARQAIRVTWGEKKSWWGYEVLTFFLLGQEAEKEDKMLALSLEDEHLLYGDIIRQDFLD
TYNNLTLKTIMAFRWVTEFCPNAKYVMKTDTDVFINTGNLVKYLLNLNHSEKFFTGYPLIDNYSYRGFYQKTHIS
YQEYPFKVFPPYCSGLGYIMSRDLVPRIYEMMGHVKPIKFEDVYVGICLNLLKVNIHIPEDTNLFFLYRIHLDVC
QLRRVIAAHGFSSKEIITFWQVMLRNTTCHY

FIGURE 163

CATTTCTGAAACTAATCGTGTCAGAATTGACTTTGAAAAGCATTGCTTTTTACAGAAGTATATTAACTTTTTAGG
AGTAATTTCTAGTTTGGATTGTAATATGAAATAATTTAAAAGGGCTTCGCTCATATATAGGAAAATCGCATATGG
TCCTAGTATTAAATTCTTATTGCTTACTGATTTTTTTGAGTTAAGAGTTGTTATATGCTAGAATATGAGGATGTG
AATATAAATAAGAGAAGAAAAAAGAATAAAGTAGATTGAGTCTCCAATTTTATGTAAGCTTCAGAAGAACTGGTT
TGTTTACATGCAAGCTTATAGTTGAAATATTTTTCAGGAATTACATGAATGACAGTCTTCGAACCAATGTGTTTG
TTCGATTTCAACCAGAGACTATAGCATGTGCTTGCATCTACCTTGCAGCTAGAGCACTTCAGATTCCGTTGCCAA
CTCGTCCCCATTGGTTTCTTCTTTTTGGTACTACAGAAGAGGAAATCCAGGAAATCTGCATAGAAACACTTAGGC
TTTATACCAGAAAAAAGCCAAACTATGAATTACTGGAAAAAGAAGTAGAAAAAAGAAAAGTAGCCTTACAAGAAG
CCAAATTAAAAGCAAAGGGATTGAATCCGGATGGAACTCCAGCCCTTTCAACCCTGGGTGGATTTTCTCCAGCCT
CCAAGCCATCATCACCAAGAGAAGTAAAAGCTGAAGAGAAATCACCAATCTCCATTAATGTGAAGACAGTCAAAA
AAGAACCTGAGGATAGACAACAGGCTTCCAAAAGCCCTTACAATGGTGTAAGAAAAGACAGCAAGAGAAGTAGAA
ATAGCAGAAGTGCAAGTCGATCGAGGTCAAGAACACGATCACGTTCTAGATCACATACTCCAAGAAGACACTATA
ATAATAGGCGGAGTCGATCTGGAACATACAGCTCGAGATCAAGAAGCAGGTCCCGCAGTCACAGTGAAAGCCCTC
GAAGACATCATAATCATGGTTCTCCTCACCTTAAGGCCAAGCATACCAGAGATGATTTAAAAAGTTCAAACAGAC
ATGGTCATAAAAGGAAAAAATCTCGTTCTCGATCTCAGAGCAAGTCTCGGGATCACTCAGATGCAGCCAAGAAAC
ACAGGCATGAAAGGGGACATCATAGGGACAGGCGTGAACGATCTCGCTCCTTTGAGAGGTCCCATAAAAGCAAGC
ACCATGGTGGCAGTCGCTCAGGACATGGCAGGCACAGGCGCTGACTTTCTCTTCCTTTGAGCCTGCATCAGTTCT
TGGTTTTGCCTATCTACAGTGTGATGTATGGACTCAATCAAAAACATTAAACGCAAACTGATTAGGATTTGATTT
CTTGAAACCCTCTAGGTCTCTAGAACACTGAGGACAGTTTCTTTTGAAAAGAACTATGTTAATTTTTTTGCACAT
TAAAATGCCCTAGCAGTATCTAATTAAAAACCATGGTCAGGTTCAATTGTACTTTATTATAGTTGTGTATTGTTT
ATTGCTATAAGAACTGGAGCGTGAATTCTGTAAAAATGTATCTTATTTTTATACAGATAAAATTGCAGACACTGT
TCTATTTAAGTGGTTATTTGTTTAAATGATGGTGAATACTTTCTTAACACTGGTTTGTCTGCATGTGTAAAGATT
TTTACAAGGAAATAAAATACAAATCTTGTTTTTTCTAAAAAAAAAAAAAAAAAAGT

FIGURE 164

MNDSLRTNVFVRFQPETIACACIYLAARALQIPLPTRPHWFLLFGTTEEEIQEICIETLRLYTRKKPNYELLEKE
VEKRKVALQEAKLKAKGLNPDGTPALSTLGGFSPASKPSSPREVKAEEKSPISINVKTVKKEPEDRQQASKSPYN
GVRKDSKRSRNSRSASRSRSRTRSRSRSHTPRRHYNNRRSRSGTYSSRSRSRSRSHSESPRRHHNHGSPHLKAKH
TRDDLKSSNRHGHKRKKSRSRSQSKSRDHSDAAKKHRHERGHHRDRRERSRSFERSHKSKHHGGSRSGHGRHRR

FIGURE 165

GGTTCCTACATCCTCTCATCTGAGAATCAGAGAGCATAATCTTCTTACGGGCCCGTGATTTATTAACGTGGCTTA
ATCTGAAGGTTCTCAGTCAAATTCTTTGTGATCTACTGATTGTGGGGGCATGGCAAGGTTTGCTTAAAGGAGCTT
GGCTGGTTTGGGCCCTTGTAGCTGACAGAAGGTGGCCAGGGAGAATGCAGCACACTGCTCGGAGAATGAAGGCGC
TTCTGTTGCTGGTCTTGCCTTGGCTCAGTCCTGCTAACTACATTGACAATGTGGGCAACCTGCACTTCCTGTATT
CAGAACTCTGTAAAGGTGCCTCCCACTACGGCCTGACCAAAGATAGGAAGAGGCGCTCACAAGATGGCTGTCCAG
ACGGCTGTGCGAGCCTCACAGCCACGGCTCCCTCCCCAGAGGTTTCTGCAGCTGCCACCATCTCCTTAATGACAG
ACGAGCCTGGCCTAGACAACCCTGCCTACGTGTCCTCGGCAGAGGACGGGCAGCCAGCAATCAGCCCAGTGGACT
CTGGCCGGAGCAACCGAACTAGGGCACGGCCCTTTGAGAGATCCACTATTAGAAGCAGATCATTTAAAAAAATAA
ATCGAGCTTTGAGTGTTCTTCGAAGGACAAAGAGCGGGAGTGCAGTTGCCAACCATGCCGACCAGGGCAGGGAAA
ATTCTGAAAACACCACTGCCCCTGAAGTCTTTCCAAGGTTGTACCACCTGATTCCAGATGGTGAAATTACCAGCA
TCAAGATCAATCGAGTAGATCCCAGTGAAAGCCTCTCTATTAGGCTGGTGGGAGGTAGCGAAACCCCACTGGTCC
ATATCATTATCCAACACATTTATCGTGATGGGGTGATCGCCAGAGACGGCCGGCTACTGCCAGGAGACATCATTC
TAAAGGTCAACGGGATGGACATCAGCAATGTCCCTCACAACTACGCTGTGCGTCTCCTGCGGCAGCCCTGCCAGG
TGCTGTGGCTGACTGTGATGCGTGAACAGAAGTTCCGCAGCAGGAACAATGGACAGGCCCCGGATGCCTACAGAC
CCCGAGATGACAGCTTTCATGTGATTCTCAACAAAAGTAGCCCCGAGGAGCAGCTTGGAATAAAACTGGTGCGCA
AGGTGGATGAGCCTGGGGTTTTCATCTTCAATGTGCTGGATGGCGGTGTGGCATATCGACATGGTCAGCTTGAGG
AGAATGACCGTGTGTTAGCCATCAATGGACATGATCTTCGATATGGCAGCCCAGAAAGTGCGGCTCATCTGATTC
AGGCCAGTGAAAGACGTGTTCACCTCGTCGTGTCCCGCCAGGTTCGGCAGCGGAGCCCTGACATCTTTCAGGAAG
CCGGCTGGAACAGCAATGGCAGCTGGTCCCCAGGGCCAGGGGAGAGGAGCAACACTCCCAAGCCCCTCCATCCTA
CAATTACTTGTCATGAGAAGGTGGTAAATATCCAAAAAGACCCCGGTGAATCTCTCGGCATGACCGTCGCAGGGG
GAGCATCACATAGAGAATGGGATTTGCCTATCTATGTCATCAGTGTTGAGCCCGGAGGAGTCATAAGCAGAGATG
GAAGAATAAAAACAGGTGACATTTTGTTGAATGTGGATGGGGTCGAACTGACAGAGGTCAGCCGGAGTGAGGCAG
TGGCATTATTGAAAAGAACATCATCCTCGATAGTACTCAAAGCTTTGGAAGTCAAAGAGTATGAGCCCCAGGAAG
ACTGCAGCAGCCCAGCAGCCCTGGACTCCAACCACAACATGGCCCCACCCAGTGACTGGTCCCCATCCTGGGTCA
TGTGGCTGGAATTACCACGGTGCTTGTATAACTGTAAAGATATTGTATTACGAAGAAACACAGCTGGAAGTCTGG
GCTTCTGCATTGTAGGAGGTTATGAAGAATACAATGGAAACAAACCTTTTTTCATCAAATCCATTGTTGAAGGAA
CACCAGCATACAATGATGGAAGAATTAGATGTGGTGATATTCTTCTTGCTGTCAATGGTAGAAGTACATCAGGAA
TGATACATGCTTGCTTGGCAAGACTGCTGAAAGAACTTAAAGGAAGAATTACTCTAACTATTGTTTCTTGGCCTG
GCACTTTTTTATAGAATCAATGATGGGTCAGAGGAAAACAGAAAAATCACAAATAGGCTAAGAAGTTGAAACACT
ATATTTATCTTGTCAGTTTTTATATTTAAAGAAAGAATACATTGTAAAAATGTCAGGAAAAGTATGATCATCTAA
TGAAAGCCAGTTACACCTCAGAAAATATGATTCCAAAAAAATTAAAACTACTAGTTTTTTTCAGTGTGGAGGAT
TTCTCATTACTCTACAACATTGTTTATATTTTTTCTATTCAATAAAAAGCCCTAAAACAACTAAAATGATTGATT
TGTATACCCCACTGAATTCAAGCTGATTTAAATTTAAAATTTGGTATATGCTGAAGTCTGCCAAGGGTACATTAT
GGCCATTTTTAATTTACAGCTAAAATATTTTTTAAAATGCATTGCTGAGAAACGTTGCTTTCATCAAACAAGAAT
AAATATTTTTCAGAAGTTAAA

FIGURE 166

MKALLLLVLPWLSPANYIDNVGNLHFLYSELCKGASHYGLTKDRKRRSQDGCPDGCASLTATAPSPEVSAAATIS
LMTDEPGLDNPAYVSSAEDGQPAISPVDSGRSNRTRARPFERSTIRSRSFKKINRALSVLRRTKSGSAVANHADQ
GRENSENTTAPEVFPRLYHLIPDGEITSIKINRVDPSESLSIRLVGGSETPLVHIIIQHIYRDGVIARDGRLLPG
DIILKVNGMDISNVPHNYAVRLLRQPCQVLWLTVMREQKFRSRNNGQAPDAYRPRDDSFHVILNKSSPEEQLGIK
LVRKVDEPGVFIFNVLDGGVAYRHGQLEENDRVLAINGHDLRYGSPESAAHLIQASERRVHLVVSRQVRQRSPDI
FQEAGWNSNGSWSPGPGERSNTPKPLHPTITCHEKVVNIQKDPGESLGMTVAGGASHREWDLPIYVISVEPGGVI
SRDGRIKTGDILLNVDGVELTEVSRSEAVALLKRTSSSIVLKALEVKEYEPQEDCSSPAALDSNHNMAPPSDWSP
SWVMWLELPRCLYNCKDIVLRRNTAGSLGFCIVGGYEEYNGNKPFFIKSIVEGTPAYNDGRIRCGDILLAVNGRS
TSGMIHACLARLLKELKGRITLTIVSWPGTFL

FIGURE 167

GGGAAAGCCATTTCGAAAACCCATCTATACAAACTATATATTTTCATTTCTGCTGCTAGCTGCCTTGGGCCTCAC
AATTTTCATTCTGTTTTCTGACTTTCAAGTTATATACCGTGGAATGGAGTTGATCCCAACCATAACATCGTGGAG
GGTTTTAATTTTGGTGGTAGCCCTCACCCAATTCTGGTGTGGCTTTCTTTGCAGAGGATTCCACCTTCAAAATCA
TGAACTCTGGCTGTTGATCAAAAGAGAATTTGGATTCTACTCTAAAAGTCAATATAGGACTTGGCAAAAGAAGCT
AGCAGAAGACTCAACCTGGCCTCCCATAAACAGGACAGATTATTCAGGTGATGGCAAAAATGGATTCTACATCAA
CGGAGGCTATGAAAGCCATGAACAGATTCCAAAAAGAAAACTCAAATTGGGAGGCCAACCCACAGAACAGCATTT
CTGGGCCAGGCTGTAATCAGAATTGTCGTCGTACATGCTCAACAGCATTGCTTTTTTCCCCAAAATTAACACATT
GTGGAGAAGTGATGATACTCTCCCCTTACCTTTCCTCTCTCCATTCAAGCATTCAAAGTATATTTTCAATGAATT
AAACCTTGCAGCAAGGGACCTTAGATAGGCTTATTCTGACTGTATGCTTTACCAATGAGAGAAAAAAATGCATTT
CCTGTATCATCCTTTTCAATAAACTGTATTCATTTTGAAAAAAAAAAAAAAAAAAAAAAA

FIGURE 168

MELIPTITSWRVLILVVALTQFWCGFLCRGFHLQNHELWLLIKREFGFYSKSQYRTWQKKLAEDSTWPPINRTDY
SGDGKNGFYINGGYESHEQIPKRKLKLGGQPTEQHFWARL

FIGURE 169

CGCTCGGGCACCAGCCGCGGCAAGGATGGAGCTGGGTTGCTGGACGCAGTTGGGGCTCACTTTTCTTCAGCTCCT
TCTCATCTCGTCCTTGCCAAGAGAGTACACAGTCATTAATGAAGCCTGCCCTGGAGCAGAGTGGAATATCATGTG
TCGGGAGTGCTGTGAATATGATCAGATTGAGTGCGTCTGCCCCGGAAAGAGGGAAGTCGTGGGTTATACCATCCC
TTGCTGCAGGAATGAGGAGAATGAGTGTGACTCCTGCCTGATCCACCCAGGTTGTACCATCTTTGAAAACTGCAA
GAGCTGCCGAAATGGCTCATGGGGGGGTACCTTGGATGACTTCTATGTGAAGGGGTTCTACTGTGCAGAGTGCCG
AGCAGGCTGGTACGGAGGAGACTGCATGCGATGTGGCCAGGTTCTGCGAGCCCCAAAGGGTCAGATTTTGTTGGA
AAGCTATCCCCTAAATGCTCACTGTGAATGGACCATTCATGCTAAACCTGGGTTTGTCATCCAACTAAGATTTGT
CATGTTGAGTCTGGAGTTTGACTACATGTGCCAGTATGACTATGTTGAGGTTCGTGATGGAGACAACCGCGATGG
CCAGATCATCAAGCGTGTCTGTGGCAACGAGCGGCCAGCTCCTATCCAGAGCATAGGATCCTCACTCCACGTCCT
CTTCCACTCCGATGGCTCCAAGAATTTTGACGGTTTCCATGCCATTTATGAGGAGATCACAGCATGCTCCTCATC
CCCTTGTTTCCATGACGGCACGTGCGTCCTTGACAAGGCTGGATCTTACAAGTGTGCCTGCTTGGCAGGCTATAC
TGGGCAGCGCTGTGAAAATCTCCTTGAAGAAAGAAACTGCTCAGACCCTGGGGGCCCAGTCAATGGGTACCAGAA
AATAACAGGGGGCCCTGGGCTTATCAACGGACGCCATGCTAAAATTGGCACCGTGGTGTCTTTCTTTTGTAACAA
CTCCTATGTTCTTAGTGGCAATGAGAAAAGAACTTGCCAGCAGAATGGAGAGTGGTCAGGGAAACAGCCCATCTG
CATAAAAGCCTGCCGAGAACCAAAGATTTCAGACCTGGTGAGAAGGAGAGTTCTTCCGATGCAGGTTCAGTCAAG
GGAGACACCATTACACCAGCTATACTCAGCGGCCTTCAGCAAGCAGAAACTGCAGAGTGCCCCTACCAAGAAGCC
AGCCCTTCCCTTTGGAGATCTGCCCATGGGATACCAACATCTGCATACCCAGCTCCAGTATGAGTGCATCTCACC
CTTCTACCGCCGCCTGGGCAGCAGCAGGAGGACATGTCTGAGGACTGGGAAGTGGAGTGGGCGGGCACCATCCTG
CATCCCTATCTGCGGGAAAATTGAGAACATCACTGCTCCAAAGACCCAAGGGTTGCGCTGGCCGTGGCAGGCAGC
CATCTACAGGAGGACCAGCGGGGTGCATGACGGCAGCCTACACAAGGGAGCGTGGTTCCTAGTCTGCAGCGGTGC
CCTGGTGAATGAGCGCACTGTGGTGGTGGCTGCCCACTGTGTTACTGACCTGGGGAAGGTCACCATGATCAAGAC
AGCAGACCTGAAAGTTGTTTTGGGGAAATTCTACCGGGATGATGACCGGGATGAGAAGACCATCCAGAGCCTACA
GATTTCTGCTATCATTCTGCATCCCAACTATGACCCCATCCTGCTTGATGCTGACATCGCCATCCTGAAGCTCCT
AGACAAGGCCCGTATCAGCACCCGAGTCCAGCCCATCTGCCTCGCTGCCAGTCGGGATCTCAGCACTTCCTTCCA
GGAGTCCCACATCACTGTGGCTGGCTGGAATGTCCTGGCAGACGTGAGGAGCCCTGGCTTCAAGAACGACACACT
GCGCTCTGGGGTGGTCAGTGTGGTGGACTCGCTGCTGTGTGAGGAGCAGCATGAGGACCATGGCATCCCAGTGAG
TGTCACTGATAACATGTTCTGTGCCAGCTGGGAACCCACTGCCCCTTCTGATATCTGCACTGCAGAGACAGGAGG
CATCGCGGCTGTGTCCTTCCCGGGACGAGCATCTCCTGAGCCACGCTGGCATCTGATGGGACTGGTCAGCTGGAG
CTATGATAAAACATGCAGCCACAGGCTCTCCACTGCCTTCACCAAGGTGCTGCCTTTTAAAGACTGGATTGAAAG
AAATATGAAATGAACCATGCTCATGCACTCCTTGAGAAGTGTTTCTGTATATCCGTCTGTACGTGTGTCATTGCG
TGAAGCAGTGTGGGCCTGAAGTGTGATTTGGCCTGTGAACTTGGCTGTGCCAGGGCTTCTGACTTCAGGGACAAA
ACTCAGTGAAGGGTGAGTAGACCTCCATTGCTGGTAGGCTGATGCCGCGTCCACTACTAGGACAGCCAATTGGAA
GATGCCAGGGCTTGCAAGAAGTAAGTTTCTTCAAAGAAGACCATATACAAAACCTCTCCACTCCACTGACCTGGT
GGTCTTCCCCAACTTTCAGTTATACGAATGCCATCAGCTTGACCAGGGAAGATCTGGGCTTCATGAGGCCCCTTT
TGAGGCTCTCAAGTTCTAGAGAGCTGCCTGTGGGACAGCCCAGGGCAGCAGAGCTGGGATGTGGTGCATGCCTTT
GTGTACATGGCCACAGTACAGTCTGGTCCTTTTCCTTCCCCATCTCTTGTACACATTTTAATAAAATAAGGGTTG
GCTTCTGAACTACAAAAAAAAAAAAAAAAAAAAAAAAAAAAAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAAAAAAAAAAAAAAA

FIGURE 170

MELGCWTQLGLTFLQLLLISSLPREYTVINEACPGAEWNIMCRECCEYDQIECVCPGKREVVGYTIPCCRNEENE
CDSCLIHPGCTIFENCKSCRNGSWGGTLDDFYVKGFYCAECRAGWYGGDCMRCGQVLRAPKGQILLESYPLNAHC
EWTIHAKPGFVIQLRFVMLSLEFDYMCQYDYVEVRDGDNRDGQIIKRVCGNERPAPIQSIGSSLHVLFHSDGSKN
FDGFHAIYEEITACSSSPCFHDGTCVLDKAGSYKCACLAGYTGQRCENLLEERNCSDPGGPVNGYQKITGGPGLI
NGRHAKIGTVVSFFCNNSYVLSGNEKRTCQQNGEWSGKQPICIKACREPKISDLVRRRVLPMQVQSRETPLHQLY
SAAFSKQKLQSAPTKKPALPFGDLPMGYQHLHTQLQYECISPFYRRLGSSRRTCLRTGKWSGRAPSCIPICGKIE
NITAPKTQGLRWPWQAAIYRRTSGVHDGSLHKGAWFLVCSGALVNERTVVVAAHCVTDLGKVTMIKTADLKVVLG
KFYRDDDRDEKTIQSLQISAIILHPNYDPILLDADIAILKLLDKARISTRVQPICLAASRDLSTSFQESHITVAG
WNVLADVRSPGFKNDTLRSGVVSVVDSLLCEEQHEDHGIPVSVTDNMFCASWEPTAPSDICTAETGGIAAVSFPG
RASPEPRWHLMGLVSWSYDKTCSHRLSTAFTKVLPFKDWIERNMK

FIGURE 171

CTGTCGTCTTTGCTTCAGCCGCAGTCGCCACTGGCTGCCTGAGGTGCTCTTACAGCCTGTTCCAAGTGTGGCTTA
ATCCGTCTCCACCACCAGATCTTTCTCCGTGGATTCCTCTGCTAAGACCGCTGCCATGCCAGTGACGGTAACCCG
CACCACCATCACAACCACCACGACGTCATCTTCGGGCCTGGGGTCCCCCATGATCGTGGGGTCCCCTCGGGCCCT
GACACAGCCCCTGGGTCTCCTTCGCCTGCTGCAGCTGGTGTCTACCTGCGTGGCCTTCTCGCTGGTGGCTAGCGT
GGGCGCCTGGACGGGGTCCATGGGCAACTGGTCCATGTTCACCTGGTGCTTCTGCTTCTCCGTGACCCTGATCAT
CCTCATCGTGGAGCTGTGCGGGCTCCAGGCCCGCTTCCCCCTGTCTTGGCGCAACTTCCCCATCACCTTCGCCTG
CTATGCGGCCCTCTTCTGCCTCTCGGCCTCCATCATCTACCCCACCACCTATGTCCAGTTCCTGTCCCACGGCCG
TTCGCGGGACCACGCCATCGCCGCCACCTTCTTCTCCTGCATCGCGTGTGTGGCTTACGCCACCGAAGTGGCCTG
GACCCGGGCCCGGCCCGGCGAGATCACTGGCTATATGGCCACCGTACCCGGGCTGCTGAAGGTGCTGGAGACCTT
CGTTGCCTGCATCATCTTCGCGTTCATCAGCGACCCCAACCTGTACCAGCACCAGCCGGCCCTGGAGTGGTGCGT
GGCGGTGTACGCCATCTGCTTCATCCTAGCGGCCATCGCCATCCTGCTGAACCTGGGGGAGTGCACCAACGTGCT
ACCCATCCCCTTCCCCAGCTTCCTGTCGGGGCTGGCCTTGCTGTCTGTCCTCCTCTATGCCACCGCCCTTGTTCT
CTGGCCCCTCTACCAGTTCGATGAGAAGTATGGCGGCCAGCCTCGGCGCTCGAGAGATGTAAGCTGCAGCCGCAG
CCATGCCTACTACGTGTGTGCCTGGGACCGCCGACTGGCTGTGGCCATCCTGACGGCCATCAACCTACTGGCGTA
TGTGGCTGACCTGGTGCACTCTGCCCACCTGGTTTTTGTCAAGGTCTAAGACTCTCCCAAGAGGCTCCCGTTCCC
TCTCCAACCTCTTTGTTCTTCTTGCCCGAGTTTTCTTTATGGAGTACTTCTTTCCTCCGCCTTTCCTCTGTTTTC
CTCTTCCTGTCTCCCCTCCCTCCCACCTTTTTCTTTCCTTCCCAATTCCTTGCACTCTAACCAGTTCTTGGATGC
ATCTTCTTCCTTCCCTTTCCTCTTGCTGTTTCCTTCCTGTGTTGTTTTGTTGCCCACATCCTGTTTTCACCCCTG
AGCTGTTTCTCTTTTTCTTTTCTTTCTTTTTTTTTTTTTTTTTAAGACGGATTCTCACTCTGTGGCCCAGGCTG
GAGTGCAGTGGTGCGATCTCAGCTCACTGCAACCCCCGCCTCCTGGGTTCAAGCGATTCTCCTCCCCCAGCCTCC
CAAGTAGCTGGGAGGACAGGTGTGAGCTGCCGCACCCAGCCTGTTTCTCTTTTTCCACTCTTCTTTTTTCTCATC
TCTTTTCTGGGTTGCCTGTCGGCTTTCTTATCTGCCTGTTTTGCAAGCACCTTCTCCTGTGTCCTTGGGAGCCCT
GAGACTTCTTTCTCTCCTTGCCTCCACCCACCTCCAAAGGTGCTGAGCTCACATCCACACCCCTTGCAGCCGTCC
ATGCCACAGCCCCCCAAGGGGCCCCATTGCCAAAGCATGCCTGCCCACCCTCGCTGTGCCTTAGTCAGTGTGTAC
GTGTGTGTGTGTGTGTGTTTGGGGGGTGGGGGGTGGGTAGCTGGGGATTGGGCCCTCTTTCTCCCAGTGGAGGAA
GGTGTGCAGTGTACTTCCCCTTTAAATTAAAAAACATATATATATATATATTTGGAGGTCAGTAATTTCCAATGG
GCGGGAGGCATTAAGCACCGACCCTGGGTCCCTAGGCCCCGCCTGGCACTCAGCCTTGCCAGAGATTGGCTCCAG
AATTTTTGCCAGGCTTACAGAACACCCACTGCCTAGAGGCCATCTTAAAGGAAGCAGGGGCTGGATGCCTTTCAT
CCCAACTATTCTCTGTGGTATGAAAAAG

FIGURE 172

</usr/seqdb2/sst/DNA/Dnaseqs.min/ss.DNA58727
<subunit 1 of 1, 322 aa, 1 stop
<MW: 35274, pI: 8.57, NX(S/T): 1
MPVTVTRTTITTTTTSSSGLGSPMIVGSPRALTQPLGLLRLLQLVSTCVAFSLVASVGAWTGSMGNWSMFTWCFC
FSVTLIILIVELCGLQARFPLSWRNFPITFACYAALFCLSASIIYPTTYVQFLSHGRSRDHAIAATFFSCIACVA
YATEVAWTRARPGEITGYMATVPGLLKVLETFVACIIFAFISDPNLYQHQPALEWCVAVYAICFILAAIAILLNL
GECTNVLPIPFPSFLSGLALLSVLLYATALVLWPLYQFDEKYGGQPRRSRDVSCSRSHAYYVCAWDRRLAVAILT
AINLLAYVADLVHSAHLVFVKV Important features:
Transmembrane domains:
amino acids 41-60 (type II), 66-85, 101-120, 137-153, 171-192, 205-226, 235-255 and 294-312

N-glycosylation site.
amino acids 66-69

Glycosaminoglycan attachment site.
amino acids 18-21

FIGURE 173

GAACGTGCCACCATGCCCAGCTAATTTTTGTATTTTTAGTAGAGACGGGGTTTCACCATGTTGGCCAGGCTGGTC
TTGAACTCGTGACCTCATGATCCGCTCACCTCGGCCTCCCAAAGTGCTGGGATTACAGGCATGAGCCACTGACGC
CTGGCCAGCCTATGCATTTTTAAGAAATTATTCTGTATTAGGTGCTGTGCTAAACATTGGGCACTACAGTGACCA
AAACAGACTGAATTCCCCAAGAGCCAAAGACCAGTGAGGGAGACCAACAAGAAACAGGAAATGCAAAAGAGACCA
TTATTACTCACTATGACTAAGGGTCACAAATGGGGTACGTTGATGGAGAGTGATTTGTTAAGAGACTACAGAGGG
AGGACAGACTACCAAGAGGGGGGCCAGGAAAGCTCCTCTGACGAGGTGGTATTTCAGCCCAAACTGGAAGAATGA
GAAAGAGCTAGCCAGCCATCAGAATAGTCCAGAAGAGATGGGGAGCACTACACTCACTACACTTTGGCCTGAGAA
AATAGCATGGGATTGGAGGAGGCTGGGGGAACACCACTTCTGCCGACCTGGGCAGGAGGCATTGAGGGCTTGAGA
AAGGGCAATGGCAGTAGCAGTAGAAAGGACAGGGTAGGAGCAGGGACTTTGCAGGTGGAATCATTAGGTCTTATC
AACAGATATGGGCAAGCAAAGCCAGGGGAGAATTGATGGTAATGCTGAGGTTTGGAGCCAGGCTAGATGGGACAG
TGGTGGGTGATGCAAAGGAAAGAGGTCAGGAAGCAGGGCCAGACGTGGGGAGAAGGTGTGGGGGTTTGGTTTCCA
TCTTGCCGAGTCTGCCGGAATGTGGATGGGAAGACCAAGAGGAGGAGCAAGGGGCAGAGGGGAAGGGAATCTTAA
AGAAGTCCTGGATGCCACACTCTTCTTCCTTCCTCCTCTTCCCTCTCCTCAGAGGTCTCACTCGTGGTTCTTCAT
TTCCTGCCCTGCCTCCATCTCCTCTGGGTGCTGGGAAAGTGGAGGATTAGCTGAAGTTTTGCTTCTCGGGGCCTG
TCTGAATCTCCATTGCTTTCTGGGAGGACATAATTCACCTGTCCTAGCTTCTTATCATCTTACATTTCCCTGTAG
CCACTGGGACATATGTGGTGTTCCTTCCTAGCTCCTGTCTCCTCCTCATGCCTTTGCTGGGTATGGGCATGTTAG
GGGGAAGGTCATTGCTGTCAGAGGGGCACTGACTTTCTAATGGTGTTACCCAAGGTGAATGTTGGAGACACAGTC
GCGATGCTGCCCAAGTCCCGGCGAGCCCTAACTATCCAGGAGATCGCTGCGCTGGCCAGGTCCTCCCTGCATGGT
ATGCAGCCCCTCCCATGTTTCTGGCCACTTTGTCCTTTCTCCTCCCGTTTGCACATCCCTTTGGAACTGTTTCCT
GTGAGTACATGCTGGGGTCTCCCCTTTCTTCCCTTGCTCAGGTGAATCTCAGCCCCTTCTCCCACCCAAAGGTTC
ACATGGATCCTAACTACTGCCACCCTTCCACCTCCCTGCACCTGTGCTCCCTGGCCTGGTCCTTTACCAGGCTTC
TCCACCCTCCCCTATCTCCAGGTATTTCCCAGGTGGTGAAGGACCACGTGACCAAGCCTACCGCCATGGCCCAGG
GCCGAGTGGCTCACCTCATTGAGTGGAAGGGCTGGAGCAAGCCGAGTGACTCACCTGCTGCCCTGGAATCAGCCT
TTTCCTCCTATTCAGACCTCAGCGAGGGCGAACAAGAGGCTCGCTTTGCAGCAGGAGTGGCTGAGCAGTTTGCCA
TCGCGGAAGCCAAGCTCCGAGCATGGTCTTCGGTGGATGGCGAGGACTCCACTGATGACTCCTATGATGAGGACT
TTGCTGGGGGAATGGACACAGACATGGCTGGGCAGCTGCCCCTGGGGCCGCACCTCCAGGACCTGTTCACCGGCC
ACCGGTTCTCCCGGCCTGTGCGCCAGGGCTCCGTGGAGCCTGAGAGCGACTGCTCACAGACCGTGTCCCCAGACA
CCCTGTGCTCTAGTCTGTGCAGCCTGGAGGATGGGTTGTTGGGCTCCCCGGCCCGGCTGGCCTCCCAGCTGCTGG
GCGATGAGCTGCTTCTCGCCAAACTGCCCCCCAGCCGGGAAAGTGCCTTCCGCAGCCTGGGCCCACTGGAGGCCC
AGGACTCACTCTACAACTCGCCCCTCACAGAGTCCTGCCTTTCCCCCGCGGAGGAGGAGCCAGCCCCCTGCAAGG
ACTGCCAGCCACTCTGCCCACCACTAACGGGCAGCTGGGAACGGCAGCGGCAAGCCTCTGACCTGGCCTCTTCTG
GGGTGGTGTCCTTAGATGAGGATGAGGCAGAGCCAGAGGAACAGTGACCCACATCATGCCTGGCAGTGGCATGCA
TCCCCCGGCTGCTGCCAGGGGCAGAGCCTCTGTGCCCAAGTGTGGGCTCAAGGCTCCCAGCAGAGCTCCACAGCC
TAGAGGGCTCCTGGGAGCGCTCGCTTCTCCGTTGTGTGTTTTGCATGAAAGTGTTTGGAGAGGAGGCAGGGGCTG
GGCTGGGGGCGCATGTCCTGCCCCCACTCCCGGGGCTTGCCGGGGGTTGCCCGGGGCCTCTGGGGCATGGCTACA
GCTGTGGCAGACAGTGATGTTCATGTTCTTAAAATGCCACACACACATTTCCTCCTCGGATAATGTGAACCACTA
AGGGGGTTGTGACTGGGCTGTGTGAGGGTGGGGTGGAGGGGGCCCAGCAACCCCCCACCCTCCCCATGCCTCTC
TCTTCTCTGCTTTTCTTCTCACTTCCGAGTCCATGTGCAGTGCTTGATAGAATCACCCCCACCTGGAGGGGCTGG
CTCCTGCCCTCCCGGAGCCTATGGGTTGAGCCGTCCCTCAAGGGCCCCTGCCCAGCTGGGCTCGTGCTGTGCTTC
ATTCACCTCTCCATCGTCTCTAAATCTTCCTCTTTTTTCCTAAAGACAGAAGGTTTTTGGTCTGTTTTTTCAGTC
GGATCTTCTCTTCTCTGGGAGGCTTTGGAATGATGAAAGCATGTACCCTCCACCCTTTTCCTGGCCCCCTAATGG
GGCCTGGGCCCTTTCCCAACCCCTCCTAGGATGTGCGGGCAGTGTGCTGGCGCCTCACAGCCAGCCGGGCTGCCC
ATTCACGCAGAGCTCTCTGAGCGGGAGGTGGAAGAAAGGATGGCTCTGGTTGCCACAGAGCTGGGACTTCATGTT
CTTCTAGAGAGGGCCACAAGAGGGCCACAGGGGTGGCCGGGAGTTGTCAGCTGATGCCTGCTGAGAGGCAGGAAT
TGTGCCAGTGAGTGACAGTCATGAGGGAGTGTCTCTTCTTGGGGAGGAAAGAAGGTAGAGCCTTTCTGTCTGAAT
GAAAGGCCAAGGCTACAGTACAGGGCCCCGCCCCAGCCAGGGTGTTAATGCCCACGTAGTGGAGGCCTCTGGCAG
ATCCTGCATTCCAAGGTCACTGGACTGTACGTTTTTATGGTTGTGGGAAGGGTGGGTGGCTTTAGAATTAAGGGC
CTTGTAGGCTTTGGCAGGTAAGAGGGCCCAAGGTAAGAACGAGAGCCAACGGGCACAAGCATTCTATATATAAGT
GGCTCATTAGGTGTTTATTTTGTTCTATTTAAGAATTTGTTTTATTAAATTAATATAAAAATCTTTGTAAATCTC
TAAAA

FIGURE 174

MFLATLSFLLPFAHPFGTVSCEYMLGSPLSSLAQVNLSPFSHPKVHMDPNYCHPSTSLHLCSLAWSFTRLLHPPL
SPGISQVVKDHVTKPTAMAQGRVAHLIEWKGWSKPSDSPAALESAFSSYSDLSEGEQEARFAAGVAEQFAIAEAK
LRAWSSVDGEDSTDDSYDEDFAGGMDTDMAGQLPLGPHLQDLFTGHRFSRPVRQGSVEPESDCSQTVSPDTLCSS
LCSLEDGLLGSPARLASQLLGDELLLAKLPPSRESAFRSLGPLEAQDSLYNSPLTESCLSPAEEEPAPCKDCQPL
CPPLTGSWERQRQASDLASSGVVSLDEDEAEPEEQ

Signal peptide:
amino acids 1-15

Casein kinase II phosphorylation site.
amino acids 123-127, 128-132, 155-159, 162-166, 166-170, 228-232, 285-289, 324-328

Tyrosine kinase phosphorylation site.
amino acids 44-52

N-myristoylation site.
amino acids 17-23, 26-32, 173-179

Prokaryotic membrane lipoprotein lipid attachment site.
amino acids 11-22

FIGURE 175

GGTTCCTGGGCGCTCTGTTACACAAGCAAGATACAGCCAGCCCCACCTAATTTTGTTTCCCTGGCACCCTCCTGC
TCAGTGCGACATTGTCACACTTAACCCATCTGTTTTCTCTAATGCACGACAGATTCCTTTCAGACAGGACAACTG
TGATATTTCAGTTCCTGATTGTAAATACCTCCTAAGCCTGAAGCTTCTGTTACTAGCCATTGTGAGCTTCAGTTT
CTTCATCTGCAAAATGGGCATAATACAATCTATTCTTGCCACATCAAGGGATTGTTATTCCTTTAAAAAAAAACC
AATACCAAAGAAGCCTACAATGTTGGCCTTAGCCAAAATTCTGTTGATTTCAACGTTGTTTTATTCACTTCTATC
GGGGAGCCATGGAAAAGAAAATCAAGACATAAACACAACACAGAACATTGCAGAAGTTTTTAAAACAATGGAAAA
TAAACCTATTTCTTTGGAAAGTGAAGCAAACTTAAACTCAGATAAAGAAAATATAACCACCTCAAATCTCAAGGC
GAGTCATTCCCCTCCTTTGAATCTACCCAACAACAGCCACGGAATAACAGATTTCTCCAGTAACTCATCAGCAGA
GCATTCTTTGGGCAGTCTAAAACCCACATCTACCATTTCCACAAGCCCTCCCTTGATCCATAGCTTTGTTTCTAA
AGTGCCTTGGAATGCACCTATAGCAGATGAAGATCTTTTGCCCATCTCAGCACATCCCAATGCTACACCTGCTCT
GTCTTCAGAAAACTTCACTTGGTCTTTGGTCAATGACACCGTGAAAACTCCTGATAACAGTTCCATTACAGTTAG
CATCCTCTCTTCAGAACCAACTTCTCCATCTGTGACCCCCTTGATAGTGGAACCAAGTGGATGGCTTACCACAAA
CAGTGATAGCTTCACTGGGTTTACCCCTTATCAAGAAAAAACAACTCTACAGCCTACCTTAAAATTCACCAATAA
TTCAAAACTCTTTCCAAATACGTCAGATCCCCAAAAAGAAAATAGAAATACAGGAATAGTATTCGGGGCCATTTT
AGGTGCTATTCTGGGTGTCTCATTGCTTACTCTTGTGGGCTACTTGTTGTGTGGAAAAAGGAAAACGGATTCATT
TTCCCATCGGCGACTTTATGACGACAGAAATGAACCAGTTCTGCGATTAGACAATGCACCGGAACCTTATGATGT
GAGTTTTGGGAATTCTAGCTACTACAATCCAACTTTGAATGATTCAGCCATGCCAGAAAGTGAAGAAAATGCACG
TGATGGCATTCCTATGGATGACATACCTCCACTTCGTACTTCTGTATAGAACTAACAGCAAAAAGGCGTTAAACA
GCAAGTGTCATCTACATCCTAGCCTTTTGACAAATTCATCTTTCAAAAGGTTACACAAAATTACTGTCACGTGGA
TTTTGTCAAGGAGAATCATAAAAGCAGGAGACCAGTAGCAGAAATGTAGACAGGATGTATCATCCAAAGGTTTTC
TTTCTTACAATTTTTGGCCATCCTGAGGCATTTACTAAGTAGCCTTAATTTGTATTTTAGTAGTATTTTCTTAGT
AGAAAATATTTGTGGAATCAGATAAAACTAAAAGATTTCACCATTACAGCCCTGCCTCATAACTAAATAATAAAA
ATTATTCCACCAAAAAATTCTAAAACAATGAAGATGACTCTTTACTGCTCTGCCTGAAGCCCTAGTACCATAATT
CAAGATTGCATTTTCTTAAATGAAAATTGAAAGGGTGCTTTTTAAAGAAAATTTGACTTAAAGCTAAAAAGAGGA
CATAGCCCAGAGTTTCTGTTATTGGGAAATTGAGGCAATAGAAATGACAGACCTGTATTCTAGTACGTTATAATT
TTCTAGATCAGCACACACATGATCAGCCCACTGAGTTATGAAGCTGACAATGACTGCATTCAACGGGGCCATGGC
AGGAAAGCTGACCCTACCCAGGAAAGTAATAGCTTCTTTAAAAGTCTTCAAAGGTTTTGGGAATTTTAACTTGTC
TTAATATATCTTAGGCTTCAATTATTTGGGTGCCTTAAAAACTCAATGAGAATCATGGT

FIGURE 176

></usr/seqdb2/sst/DNA/Dnaseqs.min/ss.DNA58732
><subunit 1 of 1, 334 aa, 1 stop
><MW: 36294, pI: 4.98, NX(S/T): 13
MLALAKILLISTLFYSLLSGSHGKENQDINTTQNIAEVFKTMENKPISLESEANLNSDKENITTSNLKASHSPPL
NLPNNSHGITDFSSNSSAEHSLGSLKPTSTISTSPPLIHSFVSKVPWNAPIADEDLLPISAHPNATPALSSENFT
WSLVNDTVKTPDNSSITVSILSSEPTSPSVTPLIVEPSGWLTTNSDSFTGFTPYQEKTTLQPTLKFTNNSKLFPN
TSDPQKENRNTGIVFGAILGAILGVSLLTLVGYLLCGKRKTDSFSHRRLYDDRNEPVLRLDNAPEPYDVSFGNSS
YYNPTLNDSAMPESEENARDGIPMDDIPPLRTSV

Signal peptide:
amino acids 1-23

Transmembrane domain:
amino acids 235-262

N-glycosylation site.
amino acids 30-34, 61-65, 79-83, 90-94, 148-152, 155-159, 163-167, 218-222, 225-229, 298-302, 307-311

FIGURE 177

ACCAGGCATTGTATCTTCAGTTGTCATCAAGTTCGCAATCAGATTGGAAAAGCTCAACTTGAAGCTTTCTTGCCT
GCAGTGAAGCAGAGAGATAGATATTATTCACGTAATAAAAAACATGGGCTTCAACCTGACTTTCCACCTTTCCTA
CAAATTCCGATTACTGTTGCTGTTGACTTTGTGCCTGACAGTGGTTGGGTGGGCCACCAGTAACTACTTCGTGGG
TGCCATTCAAGAGATTCCTAAAGCAAAGGAGTTCATGGCTAATTTCCATAAGACCCTCATTTTGGGGAAGGGAAA
AACTCTGACTAATGAAGCATCCACGAAGAAGGTAGAACTTGACAACTGTCCTTCTGTGTCTCCTTACCTCAGAGG
CCAGAGCAAGCTCATTTTCAAACCAGATCTCACTTTGGAAGAGGTACAGGCAGAAAATCCCAAAGTGTCCAGAGG
CCGGTATCGCCCTCAGGAATGTAAAGCTTTACAGAGGGTCGCCATCCTCGTTCCCCACCGGAACAGAGAGAAACA
CCTGATGTACCTGCTGGAACATCTGCATCCCTTCCTGCAGAGGCAGCAGCTGGATTATGGCATCTACGTCATCCA
CCAGGCTGAAGGTAAAAAGTTTAATCGAGCCAAACTCTTGAATGTGGGCTATCTAGAAGCCCTCAAGGAAGAAAA
TTGGGACTGCTTTATATTCCACGATGTGGACCTGGTACCCGAGAATGACTTTAACCTTTACAAGTGTGAGGAGCA
TCCCAAGCATCTGGTGGTTGGCAGGAACAGCACTGGGTACAGGTTACGTTACAGTGGATATTTTGGGGGTGTTAC
TGCCCTAAGCAGAGAGCAGTTTTTCAAGGTGAATGGATTCTCTAACAACTACTGGGGATGGGGAGGCGAAGACGA
TGACCTCAGACTCAGGGTTGAGCTCCAAAGAATGAAAATTTCCCGGCCCCTGCCTGAAGTGGGTAAATATACAAT
GGTCTTCCACACTAGAGACAAAGGCAATGAGGTGAACGCAGAACGGATGAAGCTCTTACACCAAGTGTCACGAGT
CTGGAGAACAGATGGGTTGAGTAGTTGTTCTTATAAATTAGTATCTGTGGAACACAATCCTTTATATATCAACAT
CACAGTGGATTTCTGGTTTGGTGCATGACCCTGGATCTTTTGGTGATGTTTGGAAGAACTGATTCTTTGTTTGCA
ATAATTTTGGCCTAGAGACTTCAAATAGTAGCACACATTAAGAACCTGTTACAGCTCATTGTTGAGCTGAATTTT
TCCTTTTTGTATTTTCTTAGCAGAGCTCCTGGTGATGTAGAGTATAAAACAGTTGTAACAAGACAGCTTTCTTAG
TCATTTTGATCATGAGGGTTAAATATTGTAATATGGATACTTGAAGGACTTTATATAAAAGGATGACTCAAAGGA
TAAAATGAACGCTATTTGAGGACTCTGGTTGAAGGAGATTTATTTAAATTTGAAGTAATATATTATGGGATAAAA
GGCCACAGGAAATAAGACTGCTGAATGTCTGAGAGAACCAGAGTTGTTCTCGTCCAAGGTAGAAAGGTACGAAGA
TACAATACTGTTATTCATTTATCCTGTACAATCATCTGTGAAGTGGTGGTGTCAGGTGAGAAGGCGTCCACAAAA
GAGGGGAGAAAAGGCGACGAATCAGGACACAGTGAACTTGGGAATGAAGAGGTAGCAGGAGGGTGGAGTGTCGGC
TGCAAAGGCAGCAGTAGCTGAGCTGGTTGCAGGTGCTGATAGCCTTCAGGGGAGGACCTGCCCAGGTATGCCTTC
CAGTGATGCCCACCAGAGAATACATTCTCTATTAGTTTTTAAAGAGTTTTTGTAAAATGATTTTGTACAAGTAGG
ATATGAATTAGCAGTTTACAAGTTTACATATTAACTAATAATAAATATGTCTATCAAATACCTCTGTAGTAAAAT
GTGAAAAAGCAAAA

FIGURE 178

MGFNLTFHLSYKFRLLLLLTLCLTVVGWATSNYFVGAIQEIPKAKEFMANFHKTLILGKGKTLTNEASTKKVELD
NCPSVSPYLRGQSKLIFKPDLTLEEVQAENPKVSRGRYRPQECKALQRVAILVPHRNREKHLMYLLEHLHPFLQR
QQLDYGIYVIHQAEGKKFNRAKLLNVGYLEALKEENWDCFIFHDVDLVPENDFNLYKCEEHPKHLVVGRNSTGYR
LRYSGYFGGVTALSREQFFKVNGFSNNYWGWGGEDDDLRLRVELQRMKISRPLPEVGKYTMVFHTRDKGNEVNAE
RMKLLHQVSRVWRTDGLSSCSYKLVSVEHNPLYINITVDFWFGA

Important features:
Signal peptide:
amino acids 1-27

N-glycosylation sites.
amino acids 4-8, 220-224, 335-339

Xylose isomerase proteins.
amino acids 191-202

FIGURE 179

CGTGGGCCGGGGTCGCGCAGCGGGCTGTGGGCGCGCCCGGAGGAGCGACCGCCGCAGTTCTCGAGCTCCAGCTGC
ATTCCCTCCGCGTCCGCCCCACGCTTCTCCCGCTCCGGGCCCCGCAATGGCCCAGGCAGTGTGGTCGCGCCTCGG
CCGCATCCTCTGGCTTGCCTGCCTCCTGCCCTGGGCCCCGGCAGGGGTGGCCGCAGGCCTGTATGAACTCAATCT
CACCACCGATAGCCCTGCCACCACGGGAGCGGTGGTGACCATCTCGGCCAGCCTGGTGGCCAAGGACAACGGCAG
CCTGGCCCTGCCCGCTGACGCCCACCTCTACCGCTTCCACTGGATCCACACCCCGCTGGTGCTTACTGGCAAGAT
GGAGAAGGGTCTCAGCTCCACCATCCGTGTGGTCGGCCACGTGCCCGGGGAATTCCCGGTCTCTGTCTGGGTCAC
TGCCGCTGACTGCTGGATGTGCCAGCCTGTGGCCAGGGGCTTTGTGGTCCTCCCCATCACAGAGTTCCTCGTGGG
GGACCTTGTTGTCACCCAGAACACTTCCCTACCCTGGCCCAGCTCCTATCTCACTAAGACCGTCCTGAAAGTCTC
CTTCCTCCTCCACGACCCGAGCAACTTCCTCAAGACCGCCTTGTTTCTCTACAGCTGGGACTTCGGGGACGGGAC
CCAGATGGTGACTGAAGACTCCGTGGTCTATTATAACTATTCCATCATCGGGACCTTCACCGTGAAGCTCAAAGT
GGTGGCGGAGTGGGAAGAGGTGGAGCCGGATGCCACGAGGGCTGTGAAGCAGAAGACCGGGGACTTCTCCGCCTC
GCTGAAGCTGCAGGAAACCCTTCGAGGCATCCAAGTGTTGGGGCCCACCCTAATTCAGACCTTCCAAAAGATGAC
CGTGACCTTGAACTTCCTGGGGAGCCCTCCTCTGACTGTGTGCTGGCGTCTCAAGCCTGAGTGCCTCCCGCTGGA
GGAAGGGGAGTGCCACCCTGTGTCCGTGGCCAGCACAGCGTACAACCTGACCCACACCTTCAGGGACCCTGGGGA
CTACTGCTTCAGCATCCGGGCCGAGAATATCATCAGCAAGACACATCAGTACCACAAGATCCAGGTGTGGCCCTC
CAGAATCCAGCCGGCTGTCTTTGCTTTCCCATGTGCTACACTTATCACTGTGATGTTGGCCTTCATCATGTACAT
GACCCTGCGGAATGCCACTCAGCAAAAGGACATGGTGGAGAACCCGGAGCCACCCTCTGGGGTCAGGTGCTGCTG
CCAGATGTGCTGTGGGCCTTTCTTGCTGGAGACTCCATCTGAGTACCTGGAAATTGTTCGTGAGAACCACGGGCT
GCTCCCGCCCCTCTATAAGTCTGTCAAAACTTACACCGTGTGAGCACTCCCCCTCCCCACCCCATCTCAGTGTTA
ACTGACTGCTGACTTGGAGTTTCCAGCAGGGTGGTGTGCACCACTGACCAGGAGGGGTTCATTTGCGTGGGGCTG
TTGGCCTGGATCATCCATCCATCTGTACAGTTCAGCCACTGCCACAAGCCCCTCCCTCTCTGTCACCCCTGACCC
CAGCCATTCACCCATCTGTACAGTCCAGCCACTGACATAAGCCCCACTCGGTTACCACCCCCTTGACCCCCTACC
TTTGAAGAGGCTTCGTGCAGGACTTTGATGCTTGGGGTGTTCCGTGTTGACTCCTAGGTGGGCCTGGCTGCCCAC
TGCCCATTCCTCTCATATTGGCACATCTGCTGTCCATTGGGGGTTCTCAGTTTCCTCCCCCAGACAGCCCTACCT
GTGCCAGAGAGCTAGAAAGAAGGTCATAAAGGGTTAAAAATCCATAACTAAAGGTTGTACACATAGATGGGCACA
CTCACAGAGAGAAGTGTGCATGTACACACACCACACACACACACACACACACACACACAGAAATATAAACACATG
CGTCACATGGGCATTTCAGATGATCAGCTCTGTATCTGGTTAAGTCGGTTGCTGGGATGCACCCTGCACTAGAGC
TGAAAGGAAATTTGACCTCCAAGCAGCCCTGACAGGTTCTGGGCCCGGGCCCTCCCTTTGTGCTTTGTCTCTGCA
GTTCTTGCGCCCTTTATAAGGCCATCCTAGTCCCTGCTGGCTGGCAGGGGCCTGGATGGGGGGCAGGACTAATAC
TGAGTGATTGCAGAGTGCTTTATAAATATCACCTTATTTTATCGAAACCCATCTGTGAAACTTTCACTGAGGAAA
AGGCCTTGCAGCGGTAGAAGAGGTTGAGTCAAGGCCGGGCGCGGTGGCTCACGCCTGTAATCCCAGCACTTTGGG
AGGCCGAGGCGGGTGGATCACGAGATCAGGAGATCGAGACCACCCTGGCTAACACGGTGAAACCCCGTCTCTACT
AAAAAAATACAAAAAGTTAGCCGGGCGTGGTGGTGGGTGCCTGTAGTCCCAGCTACTCGGGAGGCTGAGGCAGGA
GAATGGTGCGAACCCGGGAGGCGGAGCTTGCAGTGAGCCCAGATGGCGCCACTGCACTCCAGCCTGAGTGACAGA
GCGAGACTCTGTCTCCA

FIGURE 180

MAQAVWSRLGRILWLACLLPWAPAGVAAGLYELNLTTDSPATTGAVVTISASLVAKDNGSLALPADAHLYRFHWI
HTPLVLTGKMEKGLSSTIRVVGHVPGEFPVSVWVTAADCWMCQPVARGFVVLPITEFLVGDLVVTQNTSLPWPSS
YLTKTVLKVSFLLHDPSNFLKTALFLYSWDFGDGTQMVTEDSVVYYNYSIIGTFTVKLKVVAEWEEVEPDATRAV
KQKTGDFSASLKLQETLRGIQVLGPTLIQTFQKMTVTLNFLGSPPLTVCWRLKPECLPLEEGECHPVSVASTAYN
LTHTFRDPGDYCFSIRAENIISKTHQYHKIQVWPSRIQPAVFAFPCATLITVMLAFIMYMTLRNATQQKDMVENP
EPPSGVRCCCQMCCGPFLLETPSEYLEIVRENHGLLPPLYKSVKTYTV

Important features of the protein:
Signal peptide:
amino acids 1-24

Transmembrane domain:
amino acids 339-362

N-glycosylation sites.
amino acids 34-37, 58-61, 142-145, 197-200, 300-303 and 364-367

FIGURE 181

CGGACGCGTGGGCGGCGGCTGCGGAACTCCCGTGGAGGGGCCGGTGGGCCCTCGGGCCTGACAGATGGCAGTGGC
CACTGCGGCGGCAGTACTGGCCGCTCTGGGCGGGGCGCTGTGGCTGGCGGCCCGCCGGTTCGTGGGGCCCAGGGT
CCAGCGGCTGCGCAGAGGCGGGGACCCCGGCCTCATGCACGGGAAGACTGTGCTGATCACCGGGGCGAACAGCGG
CCTGGGCCGCGCCACGGCCGCCGAGCTACTGCGCCTGGGAGCGCGGGTGATCATGGGCTGCCGGGACCGCGCG
CGCCGAGGAGGCGGCGGGTCAGCTCCGCCGCGAGCTCCGCCAGGCCGCGGAGTGCGGCCCAGAGCCTGGCGTCAG
CGGGGTGGGCGAGCTCATAGTCCGCGAGCTGGACCTCGCCTCGCTGCGCTCGGTGCGCGCCTTCTGCCAGGAAAT
GCTCCAGGAAGAGCCTAGGCTGGATGTCTTGATCAATAACGCAGGGATCTTCCAGTGCCCTTACATGAAGACTGA
AGATGGGTTTGAGATGCAGTTCGGAGTGAACCATCTGGGGCACTTTCTACTCACCAATCTTCTCCTTGGACTCCT
CAAAAGTTCAGCTCCCAGCAGGATTGTGGTAGTTTCTTCCAAACTTTATAAATACGGAGACATCAATTTTGATGA
CTTGAACAGTGAACAAAGCTATAATAAAAGCTTTTGTTATAGCCGGAGCAAACTGGCTAACATTCTTTTTACCAG
GGAACTAGCCCGCCGCTTAGAAGGCACAAATGTCACCGTCAATGTGTTGCATCCTGGTATTGTACGGACAAATCT
GGGGAGGCACATACACATTCCACTGTTGGTCAAACCACTCTTCAATTTGGTGTCATGGGCTTTTTTCAAAACTCC
AGTAGAAGGTGCCCAGACTTCCATTTATTTGGCCTCTTCACCTGAGGTAGAAGGAGTGTCAGGAAGATACTTTGG
GGATTGTAAAGAGGAAGAACTGTTGCCCAAAGCTATGGATGAATCTGTTGCAAGAAAACTCTGGGATATCAGTGA
AGTGATGGTTGGCCTGCTAAAATAGGAACAAGGAGTAAAAGAGCTGTTTATAAAACTGCATATCAGTTATATCTG
TGATCAGGAATGGTGTGGATTGAGAACTTGTTACTTGAAGAAAAAGAATTTTGATATTGGAATAGCCTGCTAAGA
GGTACATGTGGGTATTTTGGAGTTACTGAAAAATTATTTTTGGGATAAGAGAATTTCAGCAAAGATGTTTTAAAT
ATATATAGTAAGTATAATGAATAATAAGTACAATGAAAAATACAATTATATTGTAAAATTATAACTGGGCAAGCA
TGGATGACATATTAATATTTGTCAGAATTAAGTGACTCAAAGTGCTATCGAGAGGTTTTTCAAGTATCTTTGAGT
TTCATGGCCAAAGTGTTAACTAGTTTTACTACAATGTTTGGTGTTTGTGTGGAAATTATCTGCCTGGTGTGTGCA
CACAAGTCTTACTTGGAATAAATTTACTGGTAC

FIGURE 182

</usr/seqdb2/sst/DNA/Dnaseqs.min/ss.DNA58747
<subunit 1 of 1, 336 aa, 1 stop
<MW: 36865, pI: 9.15, NX(S/T): 2
MAVATAAAVLAALGGALWLAARRFVGPRVQRLRRGGDPGLMHGKTVLITGANSGLGRATAAELLRLGARVIMGCR
DRARAEEAAGQLRRELRQAAECGPEPGVSGVGELIVRELDLASLRSVRAFCQEMLQEEPRLDVLINNAGIFQCPY
MKTEDGFEMQFGVNHLGHFLLTNLLLGLLKSSAPSRIVVVSSKLYKYGDINFDDLNSEQSYNKSFCYSRSKLANI
LFTRELARRLEGTNVTVNVLHPGIVRTNLGRHIHIPLLVKPLFNLVSWAFFKTPVEGAQTSIYLASSPEVEGVSG
RYFGDCKEEELLPKAMDESVARKLWDISEVMVGLLK

Important features:
Signal peptide:
amino acids 1-21

Short-chain alcohol dehydrogenase family protein
amino acids 134-144, 44-56 and 239-248

N-glycosylation site.
amino acids 212-215 and 239-242

FIGURE 183

AACAGGATCTCCTCTTGCAGTCTGCAGCCCAGGACGCTGATTCCAGCAGCGCCTTACCGCGCAGCCCGAAGATTC
ACTATGGTGAAAATCGCCTTCAATACCCCTACCGCCGTGCAAAAGGAGGAGGCGCGGCAAGACGTGGAGGCCCTC
CTGAGCCGCACGGTCAGAACTCAGATACTGACCGGCAAGGAGCTCCGAGTTGCCACCCAGGAAAAAGAGGGCTCC
TCTGGGAGATGTATGCTTACTCTCTTAGGCCTTTCATTCATCTTGGCAGGACTTATTGTTGGTGGAGCCTGCATT
TACAAGTACTTCATGCCCAAGAGCACCATTTACCGTGGAGAGATGTGCTTTTTTGATTCTGAGGATCCTGCAAAT
TCCCTTCGTGGAGGAGAGCCTAACTTCCTGCCTGTGACTGAGGAGGCTGACATTCGTGAGGATGACAACATTGCA
ATCATTGATGTGCCTGTCCCCAGTTTCTCTGATAGTGACCCTGCAGCAATTATTCATGACTTTGAAAAGGGAATG
ACTGCTTACCTGGACTTGTTGCTGGGGAACTGCTATCTGATGCCCCTCAATACTTCTATTGTTATGCCTCCAAAA
AATCTGGTAGAGCTCTTTGGCAAACTGGCGAGTGGCAGATATCTGCCTCAAACTTATGTGGTTCGAGAAGACCTA
GTTGCTGTGGAGGAAATTCGTGATGTTAGTAACCTTGGCATCTTTATTTACCAACTTTGCAATAACAGAAAGTCC
TTCCGCCTTCGTCGCAGAGACCTCTTGCTGGGTTTCAACAAACGTGCCATTGATAAATGCTGGAAGATTAGACAC
TTCCCCAACGAATTTATTGTTGAGACCAAGATCTGTCAAGAGTAAGAGGCAACAGATAGAGTGTCCTTGGTAATA
AGAAGTCAGAGATTTACAATATGACTTTAACATTAAGGTTTATGGGATACTCAAGATATTTACTCATGCATTTAC
TCTATTGCTTATGCTTTAAAAAAAGGAAAAAAAAAAAAAACTACTAACCACTGCAAGCTCTTGTCAAATTTTAGTT
TAATTGGCATTGCTTGTTTTTTGAAACTGAAATTACATGAGTTTCATTTTTTCTTTGCATTTATAGGGTTTAGAT
TTCTGAAAGCAGCATGAATATATCACCTAACATCCTGACAATAAATTCCATCCGTTGTTTTTTTTGTTTGTTTGT
TTTTTCTTTTCCTTTAAGTAAGCTCTTTATTCATCTTATGGTGGAGCAATTTTAAAATTTGAAATATTTTAAATT
GTTTTTGAACTTTTTGTGTAAAATATATCAGATCTCAACATTGTTGGTTTCTTTTGTTTTTCATTTTGTACAACT
TTCTTGAATTTAGAAATTACATCTTTGCAGTTCTGTTAGGTGCTCTGTAATTAACCTGACTTATATGTGAACAAT
TTTCATGAGACAGTCATTTTTAACTAATGCAGTGATTCTTTCTCACTACTATCTGTATTGTGGAATGCACAAAAT
TGTGTAGGTGCTGAATGCTGTAAGGAGTTTAGGTTGTATGAATTCTACAACCCTATAATAAATTTTACTCTATAC
AAAAAAAAAAAAAAAAAAA

FIGURE 184

</usr/seqdb2/sst/DNA/Dnaseqs.min/ss.DNA58828
<subunit 1 of 1, 263 aa, 1 stop
<MW: 29741, pI: 5.74, NX(S/T): 1
MVKIAFNTPTAVQKEEARQDVEALLSRTVRTQILTGKELRVATQEKEGSSGRCMLTLLGLSFILAGLIVGGACIY
KYFMPKSTIYRGEMCFFDSEDPANSLRGGEPNFLPVTEEADIREDDNIAIIDVPVPSFSDSDPAAIIHDFEKGMT
AYLDLLLGNCYLMPLNTSIVMPPKNLVELFGKLASGRYLPQTYVVREDLVAVEEIRDVSNLGIFIYQLCNNRKSF
RLRRRDLLLGFNKRAIDKCWKIRHFPNEFIVETKICQE

Type II transmembrane domain:
amino acids 53-75

N-glycosylation site.
amino acids 166-170

Casein kinase II phosphorylation site.
amino acids 35-39, 132-136, 134-138

N-myristoylation site.
amino acids 66-72, 103-109

Prokaryotic membrane lipoprotein lipid attachment site.
amino acids 63-74

FIGURE 185

```
GCTCAAGACCCAGCAGTGGGACAGCCAGACAGACGGCACGATGGCACTGAGCTCCCAGATCTGGGCCGCTTGCCT
CCTGCTCCTCCTCCTCCTCGCCAGCCTGACCAGTGGCTCTGTTTTCCCACAACAGACGGGACAACTTGCAGAGCT
GCAACCCCAGGACAGAGCTGGAGCCAGGGCCAGCTGGATGCCCATGTTCCAGAGGCGAAGGAGGCGAGACACCCA
CTTCCCCATCTGCATTTTCTGCTGCGGCTGCTGTCATCGATCAAAGTGTGGGATGTGCTGCAAGACGTAGAACCT
ACCTGCCCTGCCCCCGTCCCCTCCCTTCCTTATTTATTCCTGCTGCCCCAGAACATAGGTCTTGGAATAAAATGG
CTGGTTCTTTTGTTTTCCAAAAAAAAAAAAAAAAAAAAAAAAAAAAAAAAAAAAAAAAAAAAAAAAAAAAAAAAA
AAAAAAAAAAAAAAAAAAAAAAAAAAAAAAAA
```

FIGURE 186

MALSSQIWAACLLLLLLLASLTSGSVFPQQTGQLAELQPQDRAGARASWMPMFQRRRRRDTHFPICIFCCGCCHR
SKCGMCCKT

FIGURE 187

CTGTCAGGAAGGACCATCTGAAGGCTGCAATTTGTTCTTAGGGAGGCAGGTGCTGGCCTGGCCTGGATCTTCCAC
CATGTTCCTGTTGCTGCCTTTTGATAGCCTGATTGTCAACCTTCTGGGCATCTCCCTGACTGTCCTCTTCACCCT
CCTTCTCGTTTTCATCATAGTGCCAGCCATTTTTGGAGTCTCCTTTGGTATCCGCAAACTCTACATGAAAAGTCT
GTTAAAAATCTTTGCGTGGGCTACCTTGAGAATGGAGCGAGGAGCCAAGGAGAAGAACCACCAGCTTTACAAGCC
CTACACCAACGGAATCATTGCAAAGGATCCCACTTCACTAGAAGAAGAGATCAAAGAGATTCGTCGAAGTGGTAG
TAGTAAGGCTCTGGACAACACTCCAGAGTTCGAGCTCTCTGACATTTTCTACTTTTGCCGGAAAGGAATGGAGAC
CATTATGGATGATGAGGTGACAAAGAGATTCTCAGCAGAAGAACTGGAGTCCTGGAACCTGCTGAGCAGAACCAA
TTATAACTTCCAGTACATCAGCCTTCGGCTCACGGTCCTGTGGGGGTTAGGAGTGCTGATTCGGTACTGCTTTCT
GCTGCCGCTCAGGATAGCACTGGCTTTCACAGGGATTAGCCTTCTGGTGGTGGGCACAACTGTGGTGGGATACTT
GCCAAATGGGAGGTTTAAGGAATTCATGAGTAAACATGTTCACTTAATGTGTTACCGGATCTGCGTGCGAGCGCT
GACAGCCATCATCACCTACCATGACAGGGAAAACAGACCAAGAAATGGTGGCATCTGTGTGGCCAATCATACCTC
ACCGATCGATGTGATCATCTTGGCCAGCGATGGCTATTATGCCATGGTGGGTCAAGTGCACGGGGGACTCATGGG
TGTGATTCAGAGAGCCATGGTGAAGGCCTGCCCACACGTCTGGTTTGAGCGCTCGGAAGTGAAGGATCGCCACCT
GGTGGCTAAGAGACTGACTGAACATGTGCAAGATAAAAGCAAGCTGCCTATCCTCATCTTCCCAGAAGGAACCTG
CATCAATAATACATCGGTGATGATGTTCAAAAAGGGAAGTTTTGAAATTGGAGCCACAGTTTACCCTGTTGCTAT
CAAGTATGACCCTCAATTTGGCGATGCCTTCTGGAACAGCAGCAAATACGGGATGGTGACGTACCTGCTGCGAAT
GATGACCAGCTGGGCCATTGTCTGCAGCGTGTGGTACCTGCCTCCCATGACTAGAGAGGCAGATGAAGATGCTGT
CCAGTTTGCGAATAGGGTGAAATCTGCCATTGCCAGGCAGGGAGGACTTGTGGACCTGCTGTGGGATGGGGGCCT
GAAGAGGGAGAAGGTGAAGGACACGTTCAAGGAGGAGCAGCAGAAGCTGTACAGCAAGATGATCGTGGGGAACCA
CAAGGACAGGAGCCGCTCCTGAGCCTGCCTCCAGCTGGCTGGGGCCACCGTGCGGGGTGCCAACGGGCTCAGAGC
TGGAGTTGCCGCCGCCGCCCCCACTGCTGTGTCCTTTCCAGACTCCAGGGCTCCCCGGGCTGCTCTGGATCCCAG
GACTCCGGCTTTCGCCGAGCCGCAGCGGGATCCCTGTGCACCCGGCGCAGCCTACCCTTGGTGGTCTAAACGGAT
GCTGCTGGGTGTTGCGACCCAGGACGAGATGCCTTGTTTCTTTTACAATAAGTCGTTGGAGGAATGCCATTAAAG
TGAACTCCCCACCTTTGCACGCTGTGCGGGCTGAGTGGTTGGGGAGATGTGGCCATGGTCTTGTGCTAGAGATGG
CGGTACAAGAGTCTGTTATGCAAGCCCGTGTGCCAGGGATGTGCTGGGGGCGGCCACCCGCTCTCCAGGAAAGGC
ACAGCTGAGGCACTGTGGCTGGCTTCGGCCTCAACATCGCCCCCAGCCTTGGAGCTCTGCAGACATGATAGGAAG
GAAACTGTCATCTGCAGGGGCTTTCAGCAAAATGAAGGGTTAGATTTTTATGCTGCTGCTGATGGGGTTACTAAA
GGGAGGGGAAGAGGCCAGGTGGGCCGCTGACTGGGCCATGGGGAGAACGTGTGTTCGTACTCCAGGCTAACCCTG
AACTCCCCATGTGATGCGCGCTTTGTTGAATGTGTGTCTCGGTTTCCCCATCTGTAATATGAGTCGGGGGGAATG
GTGGTGATTCCTACCTCACAGGGCTGTTGTGGGGATTAAAGTGCTGCGGGTGAGTGAAGGACACATCACGTTCAG
TGTTTCAAGTACAGGCCCACAAAACGGGGCACGGCAGGCCTGAGCTCAGAGCTGCTGCACTGGGCTTTGGATTTG
TTCTTGTGAGTAAATAAAACTGGCTGGTGAATGA

FIGURE 188

MFLLLPFDSLIVNLLGISLTVLFTLLLVFIIVPAIFGVSFGIRKLYMKSLLKIFAWATLRMERGAKEKNHQLYKP
YTNGIIAKDPTSLEEEIKEIRRSGSSKALDNTPEFELSDIFYFCRKGMETIMDDEVTKRFSAEELESWNLLSRTN
YNFQYISLRLTVLWGLGVLIRYCFLLPLRIALAFTGISLLVVGTTVVGYLPNGRFKEFMSKHVHLMCYRICVRAL
TAIITYHDRENRPRNGGICVANHTSPIDVIILASDGYYAMVGQVHGGLMGVIQRAMVKACPHVWFERSEVKDRHL
VAKRLTEHVQDKSKLPILIFPEGTCINNTSVMMFKKGSFEIGATVYPVAIKYDPQFGDAFWNSSKYGMVTYLLRM
MTSWAIVCSVWYLPPMTREADEDAVQFANRVKSAIARQGGLVDLLWDGGLKREKVKDTFKEEQQKLYSKMIVGNH
KDRSRS

FIGURE 189

GCCCCTCGAAACCAGGACTCCAGCACCTCTGGTCCCGCCCTCACCCGGACCCCTGGCCCTCACGTCTCCTCCAGG
GATGGCGCTGGCGGCTTTGATGATCGCCCTCGGCAGCCTCGGCCTCCACACCTGGCAGGCCCAGGCTGTTCCCAC
CATCCTGCCCCTGGGCCTGGCTCCAGACACCTTTGACGATACCTATGTGGGTTGTGCAGAGGAGATGGAGGAGAA
GGCAGCCCCCCTGCTAAAGGAGGAAATGGCCCACCATGCCCTGCTGCGGGAATCCTGGGAGGCAGCCCAGGAGAC
CTGGGAGGACAAGCGTCGAGGGCTTACCTTGCCCCCTGGCTTCAAAGCCCAGAATGGAATAGCCATTATGGTCTA
CACCAACTCATCGAACACCTTGTACTGGGAGTTGAATCAGGCCGTGCGGACGGGCGGAGGCTCCCGGGAGCTCTA
CATGAGGCACTTTCCCTTCAAGGCCCTGCATTTCTACCTGATCCGGGCCCTGCAGCTGCTGCGAGGCAGTGGGGG
CTGCAGCAGGGGACCTGGGGAGGTGGTGTTCCGAGGTGTGGGCAGCCTTCGCTTTGAACCCAAGAGGCTGGGGGA
CTCTGTCCGCTTGGGCCAGTTTGCCTCCAGCTCCCTGGATAAGGCAGTGGCCCACAGATTTGGGGAGAAGAGGCG
GGGCTGTGTGTCTGCGCCAGGGGTGCAGCTAGGGTCACAATCTGAGGGGGCCTCCTCTCTGCCCCCCTGGAAGAC
TCTGCTCTTGGCCCCTGGAGAGTTCCAGCTCTCAGGGGTTGGGCCCTGAAAGTCCAACATCTGCCACTTAGGAGC
CCTGGGAACGGGTGACCTTCATATGACGAAGAGGCACCTCCAGCAGCCTTGAGAAGCAAGAACATGGTTCCGGAC
CCAGCCCTAGCAGCCTTCTCCCCAACCAGGATGTTGGCCTGGGGAGGCCACAGCAGGGCTGAGGGAACTCTGCTA
TGTGATGGGGACTTCCTGGGACAAGCAAGGAAAGTACTGAGGCAGCCACTTGATTGAACGGTGTTGCAATGTGGA
GACATGGAGTTTTATTGAGGTAGCTACGTGATTAAATGGTATTGCAGTGTGGA

FIGURE 190

MALAALMIALGSLGLHTWQAQAVPTILPLGLAPDTFDDTYVGCAEEMEEKAAPLLKEEMAHHALLRESWEAAQET
WEDKRRGLTLPPGFKAQNGIAIMVYTNSSNTLYWELNQAVRTGGGSRELYMRHFPFKALHFYLIRALQLLRGSGG
CSRGPGEVVFRGVGSLRFEPKRLGDSVRLGQFASSSLDKAVAHRFGEKRRGCVSAPGVQLGSQSEGASSLPPWKT
LLLAPGEFQLSGVGP

FIGURE 191

GTGGCTTCATTTCAGTGGCTGACTTCCAGAGAGCAATATGGCTGGTTCCCCAACATGCCTCACCCTCATCTATAT
CCTTTGGCAGCTCACAGGGTCAGCAGCCTCTGGACCCGTGAAAGAGCTGGTCGGTTCCGTTGGTGGGGCCGTGAC
TTTCCCCCTGAAGTCCAAAGTAAAGCAAGTTGACTCTATTGTCTGGACCTTCAACACAACCCCTCTTGTCACCAT
ACAGCCAGAAGGGGGCACTATCATAGTGACCCAAAATCGTAATAGGGAGAGAGTAGACTTCCCAGATGGAGGCTA
CTCCCTGAAGCTCAGCAAACTGAAGAAGAATGACTCAGGGATCTACTATGTGGGGATATACAGCTCATCACTCCA
GCAGCCCTCCACCCAGGAGTACGTGCTGCATGTCTACGAGCACCTGTCAAAGCCTAAAGTCACCATGGGTCTGCA
GAGCAATAAGAATGGCACCTGTGTGACCAATCTGACATGCTGCATGGAACATGGGGAAGAGGATGTGATTTATAC
CTGGAAGGCCCTGGGGCAAGCAGCCAATGAGTCCCATAATGGGTCCATCCTCCCCATCTCCTGGAGATGGGGAGA
AAGTGATATGACCTTCATCTGCGTTGCCAGGAACCCTGTCAGCAGAAACTTCTCAAGCCCCATCCTTGCCAGGAA
GCTCTGTGAAGGTGCTGCTGATGACCCAGATTCCTCCATGGTCCTCCTGTGTCTCCTGTTGGTGCCCCTCCTGCT
CAGTCTCTTTGTACTGGGGCTATTTCTTTGGTTTCTGAAGAGAGAGAGACAAGAAGAGTACATTGAAGAGAAGAA
GAGAGTGGACATTTGTCGGGAAACTCCTAACATATGCCCCCATTCTGGAGAGAACACAGAGTACGACACAATCCC
TCACACTAATAGAACAATCCTAAAGGAAGATCCAGCAAATACGGTTTACTCCACTGTGGAAATACCGAAAAAGAT
GGAAAATCCCCACTCACTGCTCACGATGCCAGACACACCAAGGCTATTTGCCTATGAGAATGTTATCTAGACAGC
AGTGCACTCCCCTAAGTCTCTGCTCA

FIGURE 192

MAGSPTCLTLIYILWQLTGSAASGPVKELVGSVGGAVTFPLKSKVKQVDSIVWTFNTTPLVTIQPEGGTIIVTQN
RNRERVDFPDGGYSLKLSKLKKNDSGIYYVGIYSSSLQQPSTQEYVLHVYEHLSKPKVTMGLQSNKNGTCVTNLT
CCMEHGEEDVIYTWKALGQAANESHNGSILPISWRWGESDMTFICVARNPVSRNFSSPILARKLCEGAADDPDSS
MVLLCLLLVPLLLSLFVLGLFLWFLKRERQEEYIEEKKRVDICRETPNICPHSGENTEYDTIPHTNRTILKEDPA
NTVYSTVEIPKKMENPHSLLTMPDTPRLFAYENVI

FIGURE 193

GGAGGAGGGAGGGCGGGCAGGCGCCAGCCCAGAGCAGCCCCGGGCACCAGCACGGACTCTCTCTTCCAGCCCAGG
TGCCCCCCACTCTCGCTCCATTCGGCGGGAGCACCCAGTCCTGTACGCCAAGGAACTGGTCCTGGGGGCACCATG
GTTTCGGCGGCAGCCCCCAGCCTCCTCATCCTTCTGTTGCTGCTGCTGGGGTCTGTGCCTGCTACCGACGCCCGC
TCTGTGCCCCTGAAGGCCACGTTCCTGGAGGATGTGGCGGGTAGTGGGGAGGCCGAGGGCTCGTCGGCCTCCTCC
CCGAGCCTCCCGCCACCCTGGACCCCGGCCCTCAGCCCCACATCGATGGGGCCCCAGCCCACAACCCTGGGGGGC
CCATCACCCCCCACCAACTTCCTGGATGGGATAGTGGACTTCTTCCGCCAGTACGTGATGCTGATTGCTGTGGTG
GGCTCCCTGGCCTTTCTGCTGATGTTCATCGTCTGTGCCGCGGTCATCACCCGGCAGAAGCAGAAGGCCTCGGCC
TATTACCCATCGTCCTTCCCCAAGAAGAAGTACGTGGACCAGAGTGACCGGGCCGGGGGCCCCCGGGCCTTCAGT
GAGGTCCCCGACAGAGCCCCCGACAGCAGGCCCGAGGAAGCCCTGGATTCCTCCCGGCAGCTCCAGGCCGACATC
TTGGCCGCCACCCAGAACCTCAAGTCCCCCACCAGGGCTGCACTGGGCGGTGGGGACGGAGCCAGGATGGTGGAG
GGCAGGGGCGCAGAGGAAGAGGAGAAGGGCAGCCAGGAGGGGGACCAGGAAGTCCAGGGACATGGGGTCCCAGTG
GAGACACCAGAGGCGCAGGAGGAGCCGTGCTCAGGGGTCCTTGAGGGGGCTGTGGTGGCCGGTGAGGGCCAAGGG
GAGCTGGAAGGGTCTCTCTTGTTAGCCCAGGAAGCCCAGGGACCAGTGGGTCCCCCCGAAAGCCCCTGTGCTTGC
AGCAGTGTCCACCCCAGTGTCTAACAGTCCTCCCGGGCTGCCAGCCCTGACTGTCGGGCCCCCAAGTGGTCACCT
CCCCGTGTATGAAAAGGCCTTCAGCCCTGACTGCTTCCTGACACTCCCTCCTTGGCCTCCCTGTGGTGCCAATCC
CAGCATGTGCTGATTCTACAGCAGGCAGAAATGCTGGTCCCCGGTGCCCCGGAGGAATCTTACCAAGTGCCATCA
TCCTTCACCTCAGCAGCCCCAAAGGGCTACATCCTACAGCACAGCTCCCCTGACAAAGTGAGGGAGGGCACGTGT
CCCTGTGACAGCCAGGATAAAACATCCCCCAAAGTGCTGGGATTACAGGCGTGAGCCACCGTGCCCGGCCCAAAC
TACTTTTTAAAACAGCTACAGGGTAAAATCCTGCAGCACCCACTCTGGAAAATACTGCTCTTAATTTTCCTGAAG
GTGGCCCCCTGTTTCTAGTTGGTCCAGGATTAGGGATGTGGGGTATAGGGCATTTAAATCCTCTCAAGCGCTCTC
CAAGCACCCCCGGCCTGGGGGTGAGTTTCTCATCCCGCTACTGCTGCTGGGATCAGGTTGAATGAATGGAACTCT
TCCTGTCTGGCCTCCAAAGCAGCCTAGAAGCTGAGGGGCTGTGTTTGAGGGGACCTCCACCCTGGGAAGTCCGA
GGGGCTGGGGAAGGGTTTCTGACGCCCAGCCTGGAGCAGGGGGGCCCTGGCCACCCCCCTGTTGCTCACACATTGT
CTGGCAGCCTGTGTCCACAATATTCGTCAGTCCTCGACAGGGAGCCTGGGCTCCGTCCTGCTTTAGGGAGGCTCT
GGCAGGAGGTCCTCTCCCCCATCCCTCCATCTGGGGCTCCCCCAACCTCTGCACAGCTCTCCAGGTGCTGAGATA
TAATGCACCAGCACAATAAACCTTTATTCCGGCCTGAAAAAAAAAAAAAAAAAAAAAAAAAAAAAAAAAAAAAA
AAAAAAAAAAAAAAAAAGA

FIGURE 194

></usr/seqdb2/sst/DNA/Dnaseqs.min/ss.DNA58852
><subunit 1 of 1, 283 aa, 1 stop
><MW: 29191, pI: 4.52, NX(S/T): 0
MVSAAAPSLLILLLLLLGSVPATDARSVPLKATFLEDVAGSGEAEGSSASSPSLPPPWTPALSPTSMGPQPTTLG
GPSPPTNFLDGIVDFFRQYVMLIAVVGSLAFLLMFIVCAAVITRQKQKASAYYPSSFPKKKYVDQSDRAGGPRAF
SEVPDRAPDSRPEEALDSSRQLQADILAATQNLKSPTRAALGGGDGARMVEGRGAEEEEKGSQEGDQEVQGHGVP
VETPEAQEEPCSGVLEGAVVAGEGQGELEGSLLLAQEAQGPVGPPESPCACSSVHPSV

Signal peptide:
amino acids 1-25

Transmembrane domain:
amino acids 94-118

N-myristoylation site.
amino acids 18-24, 40-46, 46-52, 145-151, 192-198, 193-199, 211-217, 238-244, 242-248

FIGURE 195

GAAAGACGTGGTCCTGACAGACAGACAATCCTATTCCCTACCAAAATGAAGATGCTGCTGCTGCTGTGTTTGGGA
CTGACCCTAGTCTGTGTCCATGCAGAAGAAGCTAGTTCTACGGGAAGGAACTTTAATGTAGAAAAGATTAATGGG
GAATGGCATACTATTATCCTGGCCTCTGACAAAAGAGAAAAGATAGAAGAACATGGCAACTTTAGACTTTTTCTG
GAGCAAATCCATGTCTTGGAGAATTCCTTAGTTCTTAAAGTCCATACTGTAAGAGATGAAGAGTGCTCCGAATTA
TCTATGGTTGCTGACAAAACAGAAAAGGCTGGTGAATATTCTGTGACGTATGATGGATTCAATACATTTACTATA
CCTAAGACAGACTATGATAACTTTCTTATGGCTCACCTCATTAACGAAAAGGATGGGGAAACCTTCCAGCTGATG
GGGCTCTATGGCCGAGAACCAGATTTGAGTTCAGACATCAAGGAAAGGTTTGCACAACTATGTGAGGAGCATGGA
ATCCTTAGAGAAAATATCATTGACCTATCCAATGCCAATCGCTGCCTCCAGGCCCGAGAATGAAGAATGGCCTGA
GCCTCCAGTGTTGAGTGGACACTTCTCACCAGGACTCCACCATCATCCCTTCCTATCCATACAGCATCCCCAGTA
TAAATTCTGTGATCTGCATTCCATCCTGTCTCACTGAGAAGTCCAATTCCAGTCTATCAACATGTTACCTAGGAT
ACCTCATCAAGAATCAAAGACTTCTTTAAATTTCTCTTTGATACACCCTTGACAATTTTTCATGAAATTATTCCT
CTTCCTGTTCAATAAATGATTACCCTTGCACTTAA

FIGURE 196

MKMLLLLCLGLTLVCVHAEEASSTGRNFNVEKINGEWHTIILASDKREKIEEHGNFRLFLEQIHVLENSLVLKVH
TVRDEECSELSMVADKTEKAGEYSVTYDGFNTFTIPKTDYDNFLMAHLINEKDGETFQLMGLYGREPDLSSDIKE
RFAQLCEEHGILRENIIDLSNANRCLQARE

FIGURE 197

GGCTCGAGCGTTTCTGAGCCAGGGGTGACCATGACCTGCTGCGAAGGATGGACATCCTGCAATGGATTCAGCCTG
CTGGTTCTACTGCTGTTAGGAGTAGTTCTCAATGCGATACCTCTAATTGTCAGCTTAGTTGAGGAAGACCAATTT
TCTCAAAACCCCATCTCTTGCTTTGAGTGGTGGTTCCCAGGAATTATAGGAGCAGGTCTGATGGCCATTCCAGCA
ACAACAATGTCCTTGACAGCAAGAAAAAGAGCGTGCTGCAACAACAGAACTGGAATGTTTCTTTCATCATTTTTC
AGTGTGATCACAGTCATTGGTGCTCTGTATTGCATGCTGATATCCATCCAGGCTCTCTTAAAAGGTCCTCTCATG
TGTAATTCTCCAAGCAACAGTAATGCCAATTGTGAATTTTCATTGAAAAACATCAGTGACATTCATCCAGAATCC
TTCAACTTGCAGTGGTTTTTCAATGACTCTTGTGCACCTCCTACTGGTTTCAATAAACCCACCAGTAACGACACC
ATGGCGAGTGGCTGGAGAGCATCTAGTTTCCACTTCGATTCTGAAGAAAACAAACATAGGCTTATCCACTTCTCA
GTATTTTTAGGTCTATTGCTTGTTGGAATTCTGGAGGTCCTGTTTGGGCTCAGTCAGATAGTCATCGGTTTCCTT
GGCTGTCTGTGTGGAGTCTCTAAGCGAAGAAGTCAAATTGTGTAGTTTAATGGGAATAAAATGTAAGTATCAGTA
GTTTGAAAAAAAAAAA

FIGURE 198

MTCCEGWTSCNGFSLLVLLLLGVVLNAIPLIVSLVEEDQFSQNPISCFEWWFPGIIGAGLMAIPATTMSLTARKR
ACCNNRTGMFLSSFFSVITVIGALYCMLISIQALLKGPLMCNSPSNSNANCEFSLKNISDIHPESFNLQWFFNDS
CAPPTGFNKPTSNDTMASGWRASSFHFDSEENKHRLIHFSVFLGLLLVGILEVLFGLSQIVIGFLGCLCGVSKRR
SQIV

FIGURE 199

ATCCGTTCTCTGCGCTGCCAGCTCAGGTGAGCCCTCGCCAAGGTGACCTCGCAGGACACTGGTGAAGGAGCAGTG
AGGAACCTGCAGAGTCACACAGTTGCTGACCAATTGAGCTGTGAGCCTGGAGCAGATCCGTGGGCTGCAGACCCC
CGCCCCAGTGCCTCTCCCCCTGCAGCCCTGCCCCTCGAACTGTGACATGGAGAGAGTGACCCTGGCCCTTCTCCT
ACTGGCAGGCCTGACTGCCTTGGAAGCCAATGACCCATTTGCCAATAAAGACGATCCCTTCTACTATGACTGGAA
AAACCTGCAGCTGAGCGGACTGATCTGCGGAGGGCTCCTGGCCATTGCTGGGATCGCGGCAGTTCTGAGTGGCAA
ATGCAAATACAAGAGCAGCCAGAAGCAGCACAGTCCTGTACCTGAGAAGGCCATCCCACTCATCACTCCAGGCTC
TGCCACTACTTGCTGAGCACAGGACTGGCCTCCAGGGATGGCCTGAAGCCTAACACTGGCCCCCAGCACCTCCTC
CCCTGGGAGGCCTTATCCTCAAGGAAGGACTTCTCTCCAAGGGCAGGCTGTTAGGCCCCTTTCTGATCAGGAGGC
TTCTTTATGAATTAAACTCGCCCCACCACCCCCTCA

FIGURE 200

MERVTLALLLLAGLTALEANDPFANKDDPFYYDWKNLQLSGLICGGLLAIAGIAAVLSGKCKYKSSQKQHSPVPE
KAIPLITPGSATTC

FIGURE 201

GTGGACTCTGAGAAGCCCAGGCAGTTGAGGACAGGAGAGAGAAGGCTGCAGACCCAGAGGGAGGGAGGACAGGGA
GTCGGAAGGAGGAGGACAGAGGAGGGCACAGAGACGCAGAGCAAGGGCGGCAAGGAGGAGACCCTGGTGGGAGGA
AGACACTCTGGAGAGAGAGGGGGCTGGGCAGAGATGAAGTTCCAGGGGCCCCTGGCCTGCCTCCTGCTGGCCCTC
TGCCTGGGCAGTGGGGAGGCTGGCCCCCTGCAGAGCGGAGAGGAAAGCACTGGGACAAATATTGGGGAGGCCCTT
GGACATGGCCTGGGAGACGCCCTGAGCGAAGGGGTGGGAAAGGCCATTGGCAAAGAGGCCGGAGGGGCAGCTGGC
TCTAAAGTCAGTGAGGCCCTTGGCCAAGGGACCAGAGAAGCAGTTGGCACTGGAGTCAGGCAGGTTCCAGGCTTT
GGCGCAGCAGATGCTTTGGGCAACAGGGTCGGGGAAGCAGCCCATGCTCTGGGAAACACTGGGCACGAGATTGGC
AGACAGGCAGAAGATGTCATTCGACACGGAGCAGATGCTGTCCGCGGCTCCTGGCAGGGGGTGCCTGGCCACAGT
GGTGCTTGGGAAACTTCTGGAGGCCATGGCATCTTTGGCTCTCAAGGTGGCCTTGGAGGCCAGGGCCAGGGCAAT
CCTGGAGGTCTGGGGACTCCGTGGGTCCACGGATACCCCGGAAACTCAGCAGGCAGCTTTGGAATGAATCCTCAG
GGAGCTCCCTGGGGTCAAGGAGGCAATGGAGGGCCACCAAACTTTGGGACCAACACTCAGGGAGCTGTGGCCCAG
CCTGGCTATGGTTCAGTGAGAGCCAGCAACCAGAATGAAGGGTGCACGAATCCCCCACCATCTGGCTCAGGTGGA
GGCTCCAGCAACTCTGGGGGAGGCAGCGGCTCACAGTCGGGCAGCAGTGGCAGTGGCAGCAATGGTGACAACAAC
AATGGCAGCAGCAGTGGTGGCAGCAGCAGTGGCAGCAGCAGTGGCAGCAGCAGTGGCGGCAGCAGTGGCGGCAGC
AGTGGTGGCAGCAGTGGCAACAGTGGTGGCAGCAGAGGTGACAGCGGCAGTGAGTCCTCCTGGGGATCCAGCACC
GGCTCCTCCTCCGGCAACCACGGTGGGAGCGGCGGAGGAAATGGACATAAACCCGGGTGTGAAAAGCCAGGGAAT
GAAGCCCGCGGGAGCGGGGAATCTGGGATTCAGGGCTTCAGAGGACAGGGAGTTTCCAGCAACATGAGGGAAATA
AGCAAAGAGGGCAATCGCCTCCTTGGAGGCTCTGGAGACAATTATCGGGGGCAAGGGTCGAGCTGGGGCAGTGGA
GGAGGTGACGCTGTTGGTGGAGTCAATACTGTGAACTCTGAGACGTCTCCTGGGATGTTTAACTTTGACACTTTC
TGGAAGAATTTTAAATCCAAGCTGGGTTTCATCAACTGGGATGCCATAAACAAGGACCAGAGAAGCTCTCGCATC
CCGTGACCTCCAGACAAGGAGCCACCAGATTGGATGGGAGCCCCCACACTCCCTCCTTAAAACACCACCCTCTCA
TCACTAATCTCAGCCCTTGCCCTTGAAATAAACCTTAGCTGCCCCACAAAAAAAAAAAAAAAAAAAAAAAAAAAA
AAAAAAAAAAAAAAAAAAAAAAAAAAAAAAAAAAAAAAAAAAAAAAAAAAAAAAAAAAAAAAAAAAAAAAAAAAA
AAAAAAAAA

FIGURE 202

></usr/seqdb2/sst/DNA/Dnaseqs.min/ss.DNA59212
><subunit 1 of 1, 440 aa, 1 stop
><MW: 42208, pI: 6.36, NX(S/T): 1
MKFQGPLACLLLALCLGSGEAGPLQSGEESTGTNIGEALGHGLGDALSEGVGKAIGKEAGGAAGSKVSEALGQGT
REAVGTGVRQVPGFGAADALGNRVGEAAHALGNTGHEIGRQAEDVIRHGADAVRGSWQGVPGHSGAWETSGGHGI
FGSQGGLGGQGQGNPGGLGTPWVHGYPGNSAGSFGMNPQGAPWGQGGNGGPPNFGTNTQGAVAQPGYGSVRASNQ
NEGCTNPPPSGSGGGSSNSGGGSGSQSGSSGSGSNGDNNNGSSSGGSSSGSSSGSSSGGSSGGSSGGSSGNSGGS
RGDSGSESSWGSSTGSSSGNHGGSGGGNGHKPGCEKPGNEARGSGESGIQGFRGQGVSSNMREISKEGNRLLGGS
GDNYRGQGSSWGSGGGDAVGGVNTVNSETSPGMFNFDTFWKNFKSKLGFINWDAINKDQRSSRIP

Signal peptide:
amino acids 1-21

N-glycosylation site.
amino acids 265-269

Glycosaminoglycan attachment site.
amino acids 235-239, 237-241, 244-248, 255-259, 324-328, 388-392

Casein kinase II phosphorylation site.
amino acids 26-30, 109-113, 259-263, 300-304, 304-308

N-myristoylation site.
amino acids 17-23, 32-38, 42-48, 50-56, 60-66, 61-67, 64-70, 74-80, 90-96, 96-102, 130-136, 140-146, 149-155, 152-158, 155-161, 159-165, 163-169, 178-184, 190-196, 194-200, 199-205, 218-224, 236-242, 238-244, 239-245, 240-246, 245-251, 246-252, 249-252, 253-259, 256-262, 266-272, 270-276, 271-277, 275-281, 279-285, 283-289, 284-290, 287-293, 288-294, 291-297, 292-298, 295-301, 298-304, 305-311, 311-317, 315-321, 319-325, 322-328, 323-329, 325-331, 343-349, 354-360, 356-362, 374-380, 381-387, 383-389, 387-393, 389-395, 395-401

Cell attachment sequence.
amino acids 301-304

FIGURE 203

GGAGAAGAGGTTGTGTGGGACAAGCTGCTCCCGACAGAAGGATGTCGCTGCTGAGCCTGCCCTGGCTGGGCCTCA
GACCGGTGGCAATGTCCCCATGGCTACTCCTGCTGCTGGTTGTGGGCTCCTGGCTACTCGCCCGCATCCTGGCTT
GGACCTATGCCTTCTATAACAACTGCCGCCGGCTCCAGTGTTTCCCACAGCCCCCAAAACGGAACTGGTTTTGGG
GTCACCTGGGCCTGATCACTCCTACAGAGGAGGGCTTGAAGGACTCGACCCAGATGTCGGCCACCTATTCCCAGG
GCTTTACGGTATGGCTGGGTCCCATCATCCCCTTCATCGTTTTATGCCACCCTGACACCATCCGGTCTATCACCA
ATGCCTCAGCTGCCATTGCACCCAAGGATAATCTCTTCATCAGGTTCCTGAAGCCCTGGCTGGGAGAAGGGATAC
TGCTGAGTGGCGGTGACAAGTGGAGCCGCCACCGTCGGATGCTGACGCCCGCCTTCCATTTCAACATCCTGAAGT
CCTATATAACGATCTTCAACAAGAGTGCAAACATCATGCTTGACAAGTGGCAGCACCTGGCCTCAGAGGGCAGCA
GTCGTCTGGACATGTTTGAGCACATCAGCCTCATGACCTTGGACAGTCTACAGAAATGCATCTTCAGCTTTGACA
GCCATTGTCAGGAGAGGCCCAGTGAATATATTGCCACCATCTTGGAGCTCAGTGCCCTTGTAGAGAAAAGAAGCC
AGCATATCCTCCAGCACATGGACTTTCTGTATTACCTCTCCCATGACGGGCGGCGCTTCCACAGGGCCTGCCGCC
TGGTGCATGACTTCACAGACGCTGTCATCCGGGAGCGGCGTCGCACCCTCCCCACTCAGGGTATTGATGATTTTT
TCAAAGACAAAGCCAAGTCCAAGACTTTGGATTTCATTGATGTGCTTCTGCTGAGCAAGGATGAAGATGGGAAGG
CATTGTCAGATGAGGATATAAGAGCAGAGGCTGACACCTTCATGTTTGGAGGCCATGACACCACGGCCAGTGGCC
TCTCCTGGGTCCTGTACAACCTTGCGAGGCACCCAGAATACCAGGAGCGCTGCCGACAGGAGGTGCAAGAGCTTC
TGAAGGACCGCGATCCTAAAGAGATTGAATGGGACGACCTGGCCCAGCTGCCCTTCCTGACCATGTGCGTGAAGG
AGAGCCTGAGGTTACATCCCCCAGCTCCCTTCATCTCCCGATGCTGCACCCAGGACATTGTTCTCCCAGATGGCC
GAGTCATCCCCAAAGGCATTACCTGCCTCATCGATATTATAGGGGTCCATCACAACCCAACTGTGTGGCCGGATC
CTGAGGTCTACGACCCCTTCCGCTTTGACCCAGAGAACAGCAAGGGGAGGTCACCTCTGGCTTTTATTCCTTTCT
CCGCAGGGCCCAGGAACTGCATCGGGCAGGCGTTCGCCATGGCGGAGATGAAAGTGGTCCTGGCGTTGATGCTGC
TGCACTTCCGGTTCCTGCCAGACCACACTGAGCCCCGCAGGAAGCTGGAATTGATCATGCGCGCCGAGGGCGGGC
TTTGGCTGCGGGTGGAGCCCCTGAATGTAGGCTTGCAGTGACTTTCTGACCCATCCACCTGTTTTTTTGCAGATT
GTCATGAATAAAACGGTGCTGTCAAA

FIGURE 204

MSLLSLPWLGLRPVAMSPWLLLLLVVGSWLLARILAWTYAFYNNCRRLQCFPQPPKRNWFWGHLGLITPTEEGLK
DSTQMSATYSQGFTVWLGPIIPFIVLCHPDTIRSITNASAAIAPKDNLFIRFLKPWLGEGILLSGGDKWSRHRRM
LTPAFHFNILKSYITIFNKSANIMLDKWQHLASEGSSRLDMFEHISLMTLDSLQKCIFSFDSHCQERPSEYIATI
LELSALVEKRSQHILQHMDFLYYLSHDGRRFHRACRLVHDFTDAVIRERRRTLPTQGIDDFFKDKAKSKTLDFID
VLLLSKDEDGKALSDEDIRAEADTFMFGGHDTTASGLSWVLYNLARHPEYQERCRQEVQELLKDRDPKEIEWDDL
AQLPFLTMCVKESLRLHPPAPFISRCCTQDIVLPDGRVIPKGITCLIDIIGVHHNPTVWPDPEVYDPFRFDPENS
KGRSPLAFIPFSAGPRNCIGQAFAMAEMKVVLALMLLHFRFLPDHTEPRRKLELIMRAEGGLWLRVEPLNVGLQ

FIGURE 205

TCCCTTGACAGGTCTGGTGGCTGGTTCGGGGTCTACTGAAGGCTGTCTTGATCAGGAAACTGAAGACTCTCTGCT
TTTGCCACAGCAGTTCCTGCAGCTTCCTTGAGGTGTGAACCCACATCCCTGCCCCCAGGGCCACCTGCAGGACGC
CGACACCTACCCCTCAGCAGACGCCGGAGAGAAATGAGTAGCAACAAAGAGCAGCGGTCAGCAGTGTTCGTGATC
CTCTTTGCCCTCATCACCATCCTCATCCTCTACAGCTCCAACAGTGCCAATGAGGTCTTCCATTACGGCTCCCTG
CGGGGCCGTAGCCGCCGACCTGTCAACCTCAAGAAGTGGAGCATCACTGACGGCTATGTCCCCATTCTCGGCAAC
AAGACACTGCCCTCTCGGTGCCACCAGTGTGTGATTGTCAGCAGCTCCAGCCACCTGCTGGGCACCAAGCTGGGC
CCTGAGATCGAGCGGGCTGAGTGTACAATCCGCATGAATGATGCACCCACCACTGGCTACTCAGCTGATGTGGGC
AACAAGACCACCTACCGCGTCGTGGCCCATTCCAGTGTGTTCCGCGTGCTGAGGAGGCCCCAGGAGTTTGTCAAC
CGGACCCCTGAAACCGTGTTCATCTTCTGGGGGCCCCCGAGCAAGATGCAGAAGCCCCAGGGCAGCCTCGTGCGT
GTGATCCAGCGAGCGGGCCTGGTGTTCCCCAACATGGAAGCATATGCCGTCTCTCCCGGCCGCATGCGGCAATTT
GACGACCTCTTCCGGGGTGAGACGGGCAAGGACAGGGAGAAGTCTCATTCGTGGTTGAGCACAGGCTGGTTTACC
ATGGTGATCGCGGTGGAGTTGTGTGACCACGTGCATGTCTATGGCATGGTCCCCCCCAACTACTGCAGCCAGCGG
CCCCGCCTCCAGCGCATGCCCTACCACTACTACGAGCCCAAGGGGCCGGACGAATGTGTCACCTACATCCAGAAT
GAGCACAGTCGCAAGGGCAACCACCACCGCTTCATCACCGAGAAAAGGGTCTTCTCATCGTGGGCCCAGCTGTAT
GGCATCACCTTCTCCCACCCCTCCTGGACCTAGGCCACCCAGCCTGTGGGACCTCAGGAGGGTCAGAGGAGAAGC
AGCCTCCGCCCAGCCGCTAGGCCAGGGACCATCTTCTGGCCAATCAAGGCTTGCTGGAGTGTCTCCCAGCCAATC
AGGGCCTTGAGGAGGATGTATCCTCCAGCCAATCAGGGCCTGGGGAATCTGTTGGCGAATCAGGGATTTGGGAGT
CTATGTGGTTAATCAGGGGTGTCTTTCTTGTGCAGTCAGGGTCTGCGCACAGTCAATCAGGGTAGAGGGGGTATT
TCTGAGTCAATCTGAGGCTAAGGACATGTCCTTTCCCATGAGGCCTTGGTTCAGAGCCCCAGGAATGGACCCCCC
AATCACTCCCCACTCTGCTGGGATAATGGGGTCCTGTCCCAAGGAGCTGGGAACTTGGTGTTGCCCCCTCAATTT
CCAGCACCAGAAAGAGAGATTGTGTGGGGGTAGAAGCTGTCTGGAGGCCCGGCCAGAGAATTTGTGGGGTTGTGG
AGGTTGTGGGGGCGGTGGGGAGGTCCCAGAGGTGGGAGGCTGGCATCCAGGTCTTGGCTCTGCCCTGAGACCTTG
GACAAACCCTTCCCCCTCTCTGGGCACCCTTCTGCCCACACCAGTTTCCAGTGCGGAGTCTGAGACCCTTTCCAC
CTCCCCTACAAGTGCCCTCGGGTCTGTCCTCCCCGTCTGGACCCTCCCAGCCACTATCCCTTGCTGGAAGGCTCA
GCTCTTTGGGGGGTCTGGGGTGACCTCCCCACCTCCTGGAAAACTTTAGGGTATTTTTGCGCAAACTCCTTCAGG
GTTGGGGGACTCTGAAGGAAACGGGACAAAACCTTAAGCTGTTTTCTTAGCCCCTCAGCCAGCTGCCATTAGCTT
GGCTCTTAAAGGGCCAGGCCTCCTTTTCTGCCCTCTAGCAGGGAGGTTTTCCAACTGTTGGAGGCGCCTTTGGGG
CTGCCCCTTTGTCTGGAGTCACTGGGGGCTTCCGAGGGTCTCCCTCGACCCTCTGTCGTCCTGGGATGGCTGTCG
GGAGCTGTATCACCTGGGTTCTGTCCCCTGGCTCTGTATCAGGCACTTTATTAAAGCTGGGCCTCAGTGGGGTGT
GTTTGTCTCCTGCTCTTCTGGAGCCTGGAAGGAAAGGGCTTCAGGAGGAGGCTGTGAGGCTGGAGGGACCAGATG
GAGGAGGCCAGCAGCTAGCCATTGCACACTGGGGTGATGGGTGGGGGCGGTGACTGCCCCAGACTTGGTTTTGTA
ATGATTTGTACAGGAATAAACACACCTACGCTCCGGAAAAAAAAAAAAAAAAAAAAAAAA

FIGURE 206

MSSNKEQRSAVFVILFALITILILYSSNSANEVFHYGSLRGRSRRPVNLKKWSITDGYVPILGNKTLPSRCHQCV
IVSSSSHLLGTKLGPEIERAECTIRMNDAPTTGYSADVGNKTTYRVVAHSSVFRVLRRPQEFVNRTPETVFIFWG
PPSKMQKPQGSLVRVIQRAGLVFPNMEAYAVSPGRMRQFDDLFRGETGKDREKSHSWLSTGWFTMVIAVELCDHV
HVYGMVPPNYCSQRPRLQRMPYHYYEPKGPDECVTYIQNEHSRKGNHHRFITEKRVFSSWAQLYGITFSHPSWT

Signal peptide:
amino acids 1-29

Transmembrane domain:
amino acids 9-31 (type II)

N-glycosylation site.
amino acids 64-68, 115-119 cAMP- and cGMP-dependent protein kinase phosphorylation site.
amino acids 50-54

Casein kinase II phosphorylation site.
amino acids 3-7, 29-33, 53-57, 197-201

Tyrosine kinase phosphorylation site.
amino acids 253-262

N-myristoylation site.
amino acids 37-43, 114-120, 290-294

FIGURE 207

GTAGCGCGTCTTGGGTCTCCCGGCTGCCGCTGCTGCCGCCGCCGCCTCGGGTCGTGGAGCCAGGAGCGACGTCAC
CGCCATGGCAGGCATCAAAGCTTTGATTAGTTTGTCCTTTGGAGGAGCAATCGGACTGATGTTTTTGATGCTTGG
ATGTGCCCTTCCAATATACAACAAATACTGGCCCCTCTTTGTTCTATTTTTTACATCCTTTCACCTATTCCATA
CTGCATAGCAAGAAGATTAGTGGATGATACAGATGCTATGAGTAACGCTTGTAAGGAACTTGCCATCTTTCTTAC
AACGGGCATTGTCGTGTCAGCTTTTGGACTCCCTATTGTATTTGCCAGAGCACATCTGATTGAGTGGGGAGCTTG
TGCACTTGTTCTCACAGGAAACACAGTCATCTTTGCAACTATACTAGGCTTTTTCTTGGTCTTTGGAAGCAATGA
CGACTTCAGCTGGCAGCAGTGGTGAAAAGAAATTACTGAACTATTGTCAAATGGACTTCCTGTCATTTGTTGGCC
ATTCACGCACACAGGAGATGGGGCAGTTAATGCTGAATGGTATAGCAAGCCTCTTGGGGGTATTTTAGGTGCTCC
CTTCTCACTTTTATTGTAAGCATACTATTTTCACAGAGACTTGCTGAAGGATTAAAAGGATTTTCTCTTTTGGAA
AAGCTTGACTGATTTCACACTTATCTATAGTATGCTTTTTGTGGTGTCCTGCTGAATTTAAATATTTATGTGTTT
TTCCTGTTAGGTTGATTTTTTTTGGAATCAATATGCAATGTTAAACACTTTTTTAATGTAATCATTTGCATTGGT
TAGGAATTCAGAATTCCGCCGGCTCTATTACTGGTCAAGTACATCTTTTCTCTTAAAATTATTTAGCCTCCATTA
TTACAAAAAATTATAAAAATAAGTTTTCAGTCAGTCAGGATGACATCACTCCCAATGTTATGCAGACATACAGAC
GGTTGGCATACGTTATAGACTGTATACTCAGTGCAAATATAGCTGCATTTATACCTCAGAGGGGCCAAGTGTTAA
TGCCCATGCCCTCCGTTAAGGGTTGTTGGTTTTACTGGTAGACAGATGTTTTGTGGATTGAAAATTATTTTATGG
AATTGCTACAGAGGAGTGCTTTTCTTCTCAATTGTTAGAAGAATTTATGTTAAACTTTAAGGTAAGGGTGTAAAA
ACATTTTTGAGATAAGGTTTTTATTTATGTTTATTATTGTTAGAGTGAGTTGCAATGTGGGAAGAAATGACATTG
AAATTCCAGTTTTTGAATCCTGTTTCTATTTATAAGTGAAATTTGTGATCTCCTATCAACCTTTCATGTTTTACC
CTGTTAAAATGGACATACATGGAACCACTACTGATGAGGGACAGTTGTATGTTTGCATCATATATGCCAGAAAAC
CTTCCTCTGCTTCCTCCTTTTGACTTATTTGGTATGTTGTATATATTACATAAAATAACTTTTCAAATATAGTTT
AATAACACTTAGAAGTGTTTACTTACCTGGAAAATAATTGCTATGCCGTACATTCAGAGTGCCCCCTCCCCTGCA
AGGCCTTGCCATGATTAACAAGTAACTTGTTAGTCTTACAGATAATTCATGCATTAACAGTTTAAGATTTAGACC
ATGGTAATAGTAGTTCTTATTCTCTAAGGTTATATCATATGTAATTTAAAAGTATTTTTAAGACAAGTTTCCTGT
ATACCTCTGAACTGTTTTGATTTTGAGTTCATCATGATAGATCTGCTGTTTCCTTATAAAAGGCATTTGTTGTGT
GAGTTAATGCAAAGTAGCCAAGTCCAGCTATATAGCAGCTTCAGAAACATACCTGACCAAAAAATTCCCAGTAAC
CAGGCATGATCAATTTATAGTGGTCGTTTACATCTAATAATTATCAGGACTTTTTTCAGGAGTGGGTTATAAAAA
CATTCAAGTTGGTCTGACAGTATTTTGTTAAGGATATTTGTTTGTATGTTTATTCAGTATACTTACATAAAAATT
ATTTCGCCATCAGCCAAAACTCAGTAATCATGACAGCTGTCTGTTGTTTTATGAAGTTTATTTCTCAAGAAAATG
GGAATAAATTTGGGATTTGTTCAGCTTTTTTACTAAAGATGCCTAAAGCCACAGGTTTTATTGCCTAACTTAAGC
CATGACTTTTAGATATGAGATGACGGGAAGCAGGACGAAATATCGGCGTGTGGCTGGAGCCTTCCCACTGGAGGC
TGAAAGTGGCTTGTGGTATTATAATGTTCAGATTTCAAGAGGAAGGTGCAGGTACACATGAGTTAGAGAGCTGGT
GAGACAGTTGGGAACTCTTTGTGCTTGTGATCTACTGGACTTTTTTTTTGCAGGAAGTGCATTCTCTGGTCCTTC
CCTATTTTCTGTTCTGGATGTCAGTGCAGTGCACTGCTACTGTTTTATCCACTTGGCCACAGACTTTTTCTAACA
GCTGCGTATTATTTCTATATACTAATTGCATTGGCAGCATTGTGTCTTTGACCTTGTATACTAGCTTGACATAGT
GCTGTCTCTGATTTCTAGGCTAGTTACTTGAGATATGAATTTTCCATAGAATATGCACTGATACAACATTACCAT
TCTTCTATGGAAAGAAAACTTTTGATGATGAAACAATAAAGATTTTAAATATCTATTTTAAAAAAAAAA

FIGURE 208

MAGIKALISLSFGGAIGLMFLMLGCALPIYNKYWPLFVLFFYILSPIPYCIARRLVDDTDAMSNACKELAIFLTT
GIVVSAFGLPIVFARAHLIEWGACALVLTGNTVIFATILGFFLVFGSNDDFSWQQW

FIGURE 209

CTTGCAGAGAAAGAGTCTTTTGTGCAGCACCCTTTAAAGGGTGACTCGTCCCACTTGTGTTCTCTCTCCTGGTGC
AGAGTTGCAAGCAAGTTTATCAGAGTATCGCCATGAAGTTCGTCCCCTGCCTCCTGCTGGTGACCTTGTCCTGCC
TGGGGACTTTGGGTCAGGCCCCGAGGCAAAAGCAAGGAAGCACTGGGGAGGAATTCCATTTCCAGACTGGAGGGA
GAGATTCCTGCACTATGCGTCCCAGCAGCTTGGGGCAAGGTGCTGGAGAAGTCTGGCTTCGCGTCGACTGCCGCA
ACACAGACCAGACCTACTGGTGTGAGTACAGGGGGCAGCCCAGCATGTGCCAGGCTTTTGCTGCTGACCCCAAAC
CTTACTGGAATCAAGCCCTGCAGGAGCTGAGGCGCCTTCACCATGCGTGCCAGGGGGCCCCGGTGCTTAGGCCAT
CCGTGTGCAGGGAGGCTGGACCCCAGGCCCATATGCAGCAGGTGACTTCCAGCCTCAAGGGCAGCCCAGAGCCCA
ACCAGCAGCCTGAGGCTGGGACGCCATCTCTGAGGCCCAAGGCCACAGTGAAACTCACAGAAGCAACACAGCTGG
GAAAGGACTCGATGGAAGAGCTGGGAAAAGCCAAACCCACCACCCGACCCACAGCCAAACCTACCCAGCCTGGAC
CCAGGCCCGGAGGGAATGAGGAAGCAAAGAAGAAGGCCTGGGAACATTGTTGGAAACCCTTCCAGGCCCTGTGCG
CCTTTCTCATCAGCTTCTTCCGAGGGTGACAGGTGAAAGACCCCTACAGATCTGACCTCTCCCTGACAGACAACC
ATCTCTTTTTATATTATGCCGCTTTCAATCCAACGTTCTCACACTGGAAGAAGAGAGTTTCTAATCAGATGCAAC
GGCCCAAATTCTTGATCTGCAGCTTCTCTGAAGTTTGGAAAAGAAACCTTCCTTTCTGGAGTTTGCAGAGTTCAG
CAATATGATAGGGAACAGGTGCTGATGGGCCCAAGAGTGACAAGCATACACAACTACTTATTATCTGTAGAAGTT
TTGCTTTGTTGATCTGAGCCTTCTATGAAAGTTTAAATATGTAACGCATTCATGAATTTCCAGTGTTCAGTAAAT
AGCAGCTATGTGTGTGCAAAATAAAAGAATGATTTCAGAAAAAAAAA

FIGURE 210

</usr/seqdb2/sst/DNA/Dnaseqs.min/ss.DNA59602
<subunit 1 of 1, 223 aa, 1 stop
<MW: 24581, pI: 9.28, NX(S/T): 0
MKFVPCLLLVTLSCLGTLGQAPRQKQGSTGEEFHFQTGGRDSCTMRPSSLGQGAGEVWLR
VDCRNTDQTYWCEYRGQPSMCQAFAADPKPYWNQALQELRRLHHACQGAPVLRPSVCREA
GPQAHMQQVTSSLKGSPEPNQQPEAGTPSLRPKATVKLTEATQLGKDSMEELGKAKPTTR
PTAKPTQPGPRPGGNEEAKKKAWEHCWKPFQALCAFLISFFRG

Important features:
Signal peptide:
Amino acids: 1-19

N-myristoylation sites:
Amino acids: 38-44;51-57;194-200

DNA photolyases class 1 proteins:
Amino acids: 58-69

Tyrosine kinase phosphorylation site:
Amino acids: 64-71

N-myristoylation sites:
Amino acids: 38-44;51-57;194-200

Prokaryotic membrane lipoprotein lipid attachment site:
Amino acids: 4-15

FIGURE 211

GTGCAAGGAGCCGAGGCGAGATGGGCGTCCTGGGCCGGGTCCTGCTGTGGCTGCAGCTCTGCGCACTGACCCAGGCG
GTCTCCAAACTCTGGGTCCCCAACACGGACTTCGACGTCGCAGCCAACTGGAGCCAGAACCGGACCCCGTGCGCC
GGCGGCGCCGTTGAGTTCCCGGCGGACAAGATGGTGTCAGTCCTGGTGCAAGAAGGTCACGCCGTCTCAGACATG
CTCCTGCCGCTGGATGGGGAACTCGTCCTGGCTTCAGGAGCCGGATTCGGCGTCTCAGACGTGGGCTCGCACCTG
GACTGTGGCGCGGGCGAACCTGCCGTCTTCCGCGACTCTGACCGCTTCTCCTGGCATGACCGCACCTGTGGCGCT
CTGGGGACGAGGCACCTGGCCTCTTCTTCGTGGACGCCGAGCGCGTGCCCTGCCGCCACGACGACGTCTTCTTTC
CGCCTAGTGCCTCCTTCCGCGTGGGGCTCGGCCCTGGCGCTAGCCCCGTGCGTGTCCGCAGCATCTCGGCTCTGG
GCCGGACGTTCACGCGCGACGAGGACCTGGCTGTTTTCCTGGCGTCCCGCGCGGGCCGCCTACGCTTCCACGGGC
CGGGCGCGCTGAGCGTGGGCCCCGAGGACTGCGCGGACCCGTCGGGCTGCGTCTGCGGCAACGCGGAGGCGCAGC
CGTGGATCTGCGCGGCCCTGCTCCAGCCCCT

FIGURE 212

</usr/seqdb2/sst/DNA/Dnaseqs.min/ss.DNA59603
<subunit 1 of 1, 197 aa, 1 stop
<MW: 20832, pI: 8.74, NX(S/T): 2
MGVLGRVLLWLQLCALTQAVSKLWVPNTDFDVAANWSQNRTPCAGGAVEFPADKMVSVLV
QEGHAVSDMLLPLDGELVLASGAGFGVSDVGSHLDCGAGEPAVFRDSDRFSWHDRTCGAL
GTRHLASSSWTPSACPAATTTSSFRLVPPSAWGSALALAPCVSAASRLWAGRSRATRTWL
FSWRPARAAYASTGRAR

Important features:
Signal peptide:
Amino acids 1-19

N-glycosylation site:
Amino acids 35-39

Glycosaminoglycan attachment site:
Amino acids 81-85

N-myristoylation sites:
Amino acids 82-88;118-124;153-159

C-type lectin domain proteins:
Amino acids 108-118

FIGURE 213

ATCGCATCAATTGGGAGTACCATCTTCCTCATGGGACCAGTGAAACAGCTGAAGCGAATGTTTGAGCCTACTCGT
TTGATTGCAACTATCATGGTGCTGTTGTGTTTTGCACTTACCCTGTGTTCTGCCTTTTGGTGGCATAACAAGGGA
CTTGCACTTATCTTCTGCATTTTGCAGTCTTTGGCATTGACGTGGTACAGCCTTTCCTTCATACCATTTGCAAGG
GATGCTGTGAAGAAGTGTTTTGCCGTGTGTCTTGCATAATTCATGGCCAGTTTTATGAAGCTTTGGAAGGCACTA
TGGACAGAAGCTGGTGGACAGTTTTGTAACTATCTTCGAAACCTCTGTCTTACAGACATGTGCCTTTTATCTTGC
AGCAATGTGTTGCTTGTGATTCGAACATTTGAGGGTTACTTTTGGAAGCAACAATACATTCTCGAACCTGAATGT
CAGTAGCACAGGATGAGAAGTGGGTTCTGTATCTTGTGGAGTGGAATCTTCCTCATGTACCTGTTTCCTCTCTGG
ATGTTGTCCCACTGAATTCCCATGAATACAAACCTATTCAGCAACAGCAAAAAAAAAAAAAAAAAAAAAAAAAAA
AAAAAAAAAAAAAAAAAAAAAAAAAAAAAAAAAAAAAAAAA

FIGURE 214

MGPVKQLKRMFEPTRLIATIMVLLCFALTLCSAFWWHNKGLALIFCILQSLALTWYSLSFIPFARDAVKKCFAVCLA

FIGURE 215

```
GGATTTTTGTGATCCGCGATTCGCTCCCACGGGCGGGACCTTTGTAACTGCGGGAGGCCCAGGACAGGCCCACCC
TGCGGGGCGGGAGGCAGCCGGGGTGAGGGAGGTGAAGAAACCAAGACGCAGAGAGGCCAAGCCCCTTGCCTTGGG
TCACACAGCCAAAGGAGGCAGAGCCAGAACTCACAACCAGATCCAGAGGCAACAGGGAC**ATG**GCCACCTGGGACG
AAAAGGCAGTCACCCGCAGGGCCAAGGTGGCTCCCGCTGAGAGGATGAGCAAGTTCTTAAGGCACTTCACGGTCG
TGGGAGACGACTACCATGCCTGGAACATCAACTACAAGAAATGGGAGAATGAAGAGGAGGAGGAGGAGGAGGAGC
AGCCACCACCCACACCAGTCTCAGGCGAGGAAGGCAGAGCTGCAGCCCCTGACGTTGCCCCTGCCCCTGGCCCCG
CACCCAGGGCCCCCCTTGACTTCAGGGGCATGTTGAGGAAACTGTTCAGCTCCCACAGGTTTCAGGTCATCATCA
TCTGCTTGGTGGTTCTGGATGCCCTCCTGGTGCTTGCTGAGCTCATCCTGGACCTGAAGATCATCCAGCCCGACA
AGAATAACTATGCTGCCATGGTATTCCACTACATGAGCATCACCATCTTGGTCTTTTTTATGATGGAGATCATCT
TTAAATTATTTGTCTTCCGCCTGAGTTCTTTCACCACAAGTTTGAGATCCTGGATGCCCGTCGTGGTGGTGGTCT
CATTCATCCTGGACATTGTCCTCCTGTTCCAGGAGCACCAGTTTGAGGCTCTGGGCCTGCTGATTCTGCTCCGGC
TGTGGCGGGTGGCCCGGATCATCAATGGGATTATCATCTCAGTTAAGACACGTTCAGAACGGCAACTCTTAAGGT
TAAAACAGATGAATGTACAATTGGCCGCCAAGATTCAACACCTTGAGTTCAGCTGCTCTGAGAAGCCCCTGGAC**T**
**GA**TGAGTTTGCTGTATCAACCTGTAAGGAGAAGCTCTCTCCGGATGGCTATGGGAATGAAAGAATCCGACTTCTA
CTCTCACACAGCCACCGTGAAAGTCCTGGAGTAAAATGTGCTGTGTACAGAAGAGAGAGAAGGAAGCAGGCTGGC
ATGTTCACTGGGCTGGTGTTACGACAGAGAACCTGACAGTCACTGGCCAGTTATCACTTCAGATTACAAATCACA
CAGAGCATCTGCCTGTTTTCAATCACAAGAGAACAAAACCAAAATCTATAAAGATATTCTGAAAATATGACAGAA
TTTGACAAATAAAAGCATAAACGTGTAAAAAAAAAAAAAAAAAAAAAAAAAAAAAAAAAAA
```

FIGURE 216

MATWDEKAVTRRAKVAPAERMSKFLRHFTVVGDDYHAWNINYKKWENEEEEEEEEQPPPTPVSGEEGRAAAPDVA
PAPGPAPRAPLDFRGMLRKLFSSHRFQVIIICLVVLDALLVLAELILDLKIIQPDKNNYAAMVFHYMSITILVFF
MMEIIFKLFVFRLSSFTTSLRSWMPVVVVVSFILDIVLLFQEHQFEALGLLILLRLWRVARIINGIIISVKTRSE
RQLLRLKQMNVQLAAKIQHLEFSCSEKPLD

FIGURE 217

```
GGAAGGCAGCGGCAGCTCCACTCAGCCAGTACCCAGATACGCTGGGAACCTTCCCCAGCCATGGCTTCCCTGGGG
CAGATCCTCTTCTGGAGCATAATTAGCATCATCATTATTCTGGCTGGAGCAATTGCACTCATCATTGGCTTTGGT
ATTTCAGGGAGACACTCCATCACAGTCACTACTGTCGCCTCAGCTGGGAACATTGGGGAGGATGGAATCCTGAGC
TGCACTTTTGAACCTGACATCAAACTTTCTGATATCGTGATACAATGGCTGAAGGAAGGTGTTTTAGGCTTGGTC
CATGAGTTCAAAGAAGGCAAAGATGAGCTGTCGGAGCAGGATGAAATGTTCAGAGGCCGGACAGCAGTGTTTGCT
GATCAAGTGATAGTTGGCAATGCCTCTTTGCGGCTGAAAAACGTGCAACTCACAGATGCTGGCACCTACAAATGT
TATATCATCACTTCTAAAGGCAAGGGGAATGCTAACCTTGAGTATAAAACTGGAGCCTTCAGCATGCCGGAAGTG
AATGTGGACTATAATGCCAGCTCAGAGACCTTGCGGTGTGAGGCTCCCCGATGGTTCCCCCAGCCCACAGTGGTC
TGGGCATCCCAAGTTGACCAGGGAGCCAACTTCTCGGAAGTCTCCAATACCAGCTTTGAGCTGAACTCTGAGAAT
GTGACCATGAAGGTTGTGTCTGTGCTCTACAATGTTACGATCAACAACACATACTCCTGTATGATTGAAAATGAC
ATTGCCAAAGCAACAGGGGATATCAAAGTGACAGAATCGGAGATCAAAAGGCGGAGTCACCTACAGCTGCTAAAC
TCAAAGGCTTCTCTGTGTGTCTCTTCTTTCTTTGCCATCAGCTGGGCACTTCTGCCTCTCAGCCCTTACCTGATG
CTAAAATAATGTGCCTTGGCCACAAAAAAGCATGCAAAGTCATTGTTACAACAGGGATCTACAGAACTATTTCAC
CACCAGATATGACCTAGTTTTATATTTCTGGGAGGAAATGAATTCATATCTAGAAGTCTGGAGTGAGCAAACAAG
AGCAAGAAACAAAAAGAAGCCAAAAGCAGAAGGCTCCAATATGAACAAGATAAATCTATCTTCAAAGACATATTA
GAAGTTGGGAAAATAATTCATGTGAACTAGACAAGTGTGTTAAGAGTGATAAGTAAAATGCACGTGGAGACAAGT
GCATCCCCAGATCTCAGGGACCTCCCCCTGCCTGTCACCTGGGGAGTGAGAGGACAGGATAGTGCATGTTCTTTG
TCTCTGAATTTTTAGTTATATGTGCTGTAATGTTGCTCTGAGGAAGCCCCTGGAAAGTCTATCCCAACATATCCA
CATCTTATATTCCACAAATTAAGCTGTAGTATGTACCCTAAGACGCTGCTAATTGACTGCCACTTCGCAACTCAG
GGGCGGCTGCATTTTAGTAATGGGTCAAATGATTCACTTTTTATGATGCTTCCAAAGGTGCCTTGGCTTCTCTTC
CCAACTGACAAATGCCAAAGTTGAGAAAAATGATCATAATTTTAGCATAAACAGAGCAGTCGGGGACACCGATTT
TATAAATAAACTGAGCACCTTCTTTTTAAACAAAAAAAAAAAAAAAAAAAAAAAAAAAAAAAAAAAAAAAAAAAA
AAAAAAAA
```

FIGURE 218

MASLGQILFWSIISIIIILAGAIALIIGFGISGRHSITVTTVASAGNIGEDGILSCTFEPDIKLSDIVIQWLKEG
VLGLVHEFKEGKDELSEQDEMFRGRTAVFADQVIVGNASLRLKNVQLTDAGTYKCYIITSKGKGNANLEYKTGAF
SMPEVNVDYNASSETLRCEAPRWFPQPTVVWASQVDQGANFSEVSNTSFELNSENVTMKVVSVLYNVTINNTYSC
MIENDIAKATGDIKVTESEIKRRSHLQLLNSKASLCVSSFFAISWALLPLSPYLMLK

FIGURE 219

```
GAATTTGTAGAAGACAGCGGCGTTGCCATGGCGGCGTCTCTGGGGCAGGTGTTGGCTCTGGTGCTGGTGGCCGCT
CTGTGGGGTGGCACGCAGCCGCTGCTGAAGCGGGCCTCCGCCGGCCTGCAGCGGGTTCATGAGCCGACCTGGGCC
CAGCAGTTGCTACAGGAGATGAAGACCCTCTTCTTGAATACTGAGTACCTGATGCCCTTTCTCCTCAACCAGTGT
GGATCCCTTCTCTATTACCTCACCTTGGCATCGACAGATCTGACCCTGGCTGTGCCCATCTGTAACTCTCTGGCT
ATCATCTTCACACTGATTGTTGGGAAGGCCCTTGGAGAAGATATTGGTGGAAAACGTAAGTTAGACTACTGCGAG
TGCGGGACGCAGCTCTGTGGATCTCGACATACCTGTGTTAGTTCCTTCCCAGAACCCATCTCCCCAGAGTGGGTG
AGGACACGGCCTTTTCCCATCCTGCCCTTTCCTCTGCAGCTGTTTTGCTTCCTTGTGGCCATCAGAGTTCCCTTC
CCCTGGACAGTCTGGAGAAAGACAGAGGCTGGGGTTTGGGATTGAAGACCAGACCCCATCTGAGCCCTTCCTCCA
GCCCTGTACCAGCTCCTACTGGCATGGCTGAGCTCAGACCCTCCTGATTTCTGCCTATTATCCCAGGAGCAGTTG
CTGGCATGGTGCTCACCGTGATAGGAATTTCACTCTGCATCACAAGCTCAGTGAGTAAGACCCAGGGGCAACAGT
CTACCCTTTGAGTGGGCCGAACCCACTTCCAGCTCTGCTGCCTCCAGGAAGCCCCTGGGCCATGAAGTGCTGGCA
GTGAGCGGATGGACCTAGCACTTCCCCTCTCTGGCCTTAGCTTCCTCCTCTCTTATGGGGATAACAGCTACCTCA
TGGATCACAATAAGAGAACAAGAGTGAAAGAGTTTTGTAACCTTCAAGTGCTGTTCAGCTGCGGGGATTTAGCAC
AGGAGACTCTACGCTCACCCTCAGCAACCTTTCTGCCCCAGCAGCTCTCTTCCTGCTAACATCTCAGGCTCCCAG
CCCAGCCACCATTACTGTGGCCTGATCTGGACTATCATGGTGGCAGGTTCCATGGACTGCAGAACTCCAGCTGCA
TGGAAAGGGCCAGCTGCAGACTTTGAGCCAGAAATGCAAACGGGAGGCCTCTGGGACTCAGTCAGAGCGCTTTGG
CTGAATGAGGGGTGGAACCGAGGGAAGAAGGTGCGTCGGAGTGGCAGATGCAGGAAATGAGCTGTCTATTAGCCT
TGCCTGCCCCACCCATGAGGTAGGCAGAAATCCTCACTGCCAGCCCCTCTTAAACAGGTAGAGAGCTGTGAGCCC
CAGCCCCACCTGACTCCAGCACACCTGGCGAGTAGTAGCTGTCAATAAATCTATGTAAACAGACAAAAAAAAAAA
AAAAAAAAAAAAAAAAAAAAAAAAAAAAAAAAAAAAAAAAAAAAAAAAAAAAAAAAAAA
```

FIGURE 220

MAASLGQVLALVLVAALWGGTQPLLKRASAGLQRVHEPTWAQQLLQEMKTLFLNTEYLMPFLLNQCGSLLYYLTL
ASTDLTLAVPICNSLAIIFTLIVGKALGEDIGGKRKLDYCECGTQLCGSRHTCVSSFPEPISPEWVRTRPFPILP
FPLQLFCFLVAIRVPFPWTVWRKTEAGVWD

FIGURE 221

```
CTTCTGTAGGACAGTCACCAGGCCAGATCCAGAAGCCTCTCTAGGCTCCAGCTTTCTCTGTGGAAGATGACAGCA
ATTATAGCAGGACCCTGCCAGGCTGTCGAAAAGATTCCGCAATAAAACTTTGCCAGTGGGAAGTACCTAGTGAAA
CGGCCTAAGATGCCACTTCTTCTCATGTCCCAGGCTTGAGGCCCTGTGGTCCCCATCCTTGGGAGAAGTCAGCTC
CAGCACC**ATG**AAGGGCATCCTCGTTGCTGGTATCACTGCAGTGCTTGTTGCAGCTGTAGAATCTCTGAGCTGCGT
GCAGTGTAATTCATGGGAAAAATCCTGTGTCAACAGCATTGCCTCTGAATGTCCCTCACATGCCAACACCAGCTG
TATCAGCTCCTCAGCCAGCTCCTCTCTAGAGACACCAGTCAGATTATACCAGAATATGTTCTGCTCAGCGGAGAA
CTGCAGTGAGGAGACACACATTACAGCCTTCACTGTCCACGTGTCTGCTGAAGAACACTTTCATTTTGTAAGCCA
GTGCTGCCAAGGAAAGGAATGCAGCAACACCAGCGATGCCCTGGACCCTCCCCTGAAGAACGTGTCCAGCAACGC
AGAGTGCCCTGCTTGTTATGAATCTAATGGAACTTCCTGTCGTGGGAAGCCCTGGAAATGCTATGAAGAAGAACA
GTGTGTCTTTCTAGTTGCAGAACTTAAGAATGACATTGAGTCTAAGAGTCTCGTGCTGAAAGGCTGTTCCAACGT
CAGTAACGCCACCTGTCAGTTCCTGTCTGGTGAAAACAAGACTCTTGGAGGAGTCATCTTTCGAAAGTTTGAGTG
TGCAAATGTAAACAGCTTAACCCCCACGTCTGCACCAACCACTTCCCACAACGTGGGCTCCAAAGCTTCCCTCTA
CCTCTTGGCCCTTGCCAGCCTCCTTCTTCGGGGACTGCTGCCC**TGA**GGTCCTGGGGCTGCACTTTGCCCAGCACC
CCATTTCTGCTTCTCTGAGGTCCAGAGCACCCCCTGCGGTGCTGACACCCTCTTTCCCTGCTCTGCCCCGTTTAA
CTGCCCAGTAAGTGGGAGTCACAGGTCTCCAGGCAATGCCGACAGCTGCCTTGTTCTTCATTATTAAAGCACTGG
TTCATTCACTGCCAAAAAAAAAAAAAAAAAAAAAAAAAAA
```

FIGURE 222

MKGILVAGITAVLVAAVESLSCVQCNSWEKSCVNSIASECPSHANTSCISSSASSSLETPVRLYQNMFCSAENCS
EETHITAFTVHVSAEEHFHFVSQCCQGKECSNTSDALDPPLKNVSSNAECPACYESNGTSCRGKPWKCYEEEQCV
FLVAELKNDIESKSLVLKGCSNVSNATCQFLSGENKTLGGVIFRKFECANVNSLTPTSAPTTSHNVGSKASLYLL
ALASLLLRGLLP

FIGURE 223

GGCCTCGGTTCAAACGACCCGGTGGGTCTACAGCGGAAGGGAGGGAGCGAAGGTAGGAGGCAGGGCTTGCCTCAC
TGGCCACCCTCCCAACCCCAAGAGCCCAGCCCCATGGTCCCCGCCGCCGGCGCGCTGCTGTGGGTCCTGCTGCTG
AATCTGGGTCCCCGGGCGGCGGGGGCCCAAGGCCTGACCCAGACTCCGACCGAAATGCAGCGGGTCAGTTTACGC
TTTGGGGGCCCCATGACCCGCAGCTACCGGAGCACCGCCCGGACTGGTCTTCCCCGGAAGACAAGGATAATCCTA
GAGGACGAGAATGATGCCATGGCCGACGCCGACCGCCTGGCTGGACCAGCGGCTGCCGAGCTCTTGGCCGCCACG
GTGTCCACCGGCTTTAGCCGGTCGTCCGCCATTAACGAGGAGGATGGGTCTTCAGAAGAGGGGGTTGTGATTAAT
GCCGGAAAGGATAGCACCAGCAGAGAGCTTCCCAGTGCGACTCCCAATACAGCGGGGAGTTCCAGCACGAGGTTT
ATAGCCAATAGTCAGGAGCCTGAAATCAGGCTGACTTCAAGCCTGCCGCGCTCCCCCGGGAGGTCTACTGAGGAC
CTGCCAGGCTCGCAGGCCACCCTGAGCCAGTGGTCCACACCTGGGTCTACCCCGAGCCGGTGGCCGTCACCCTCA
CCCACAGCCATGCCATCTCCTGAGGATCTGCGGCTGGTGCTGATGCCCTGGGGCCCGTGGCACTGCCACTGCAAG
TCGGGCACCATGAGCCGGAGCCGGTCTGGGAAGCTGCACGGCCTTTCCGGGCGCCTTCGAGTTGGGGCGCTGAGC
CAGCTCCGCACGGAGCACAAGCCTTGCACCTATCAACAATGTCCCTGCAACCGACTTCGGGAAGAGTGCCCCCTG
GACACAAGTCTCTGTACTGACACCAACTGTGCCTCTCAGAGCACCACCAGTACCAGGACCACCACTACCCCCTTC
CCCACCATCCACCTCAGAAGCAGTCCCAGCCTGCCACCCGCCAGCCCCTGCCCAGCCCTGGCTTTTTGGAAACGG
GTCAGGATTGGCCTGGAGGATATTTGGAATAGCCTCTCTTCAGTGTTCACAGAGATGCAACCAATAGACAGAAAC
CAGAGGTAATGGCCACTTCATCCACATGAGGAGATGTCAGTATCTCAACCTCTCTTGCCCTTTCAATCCTAGCAC
CCACTAGATATTTTTAGTACAGAAAAACAAAACTGGAAAACACAA

FIGURE 224

MVPAAGALLWVLLLNLGPRAAGAQGLTQTPTEMQRVSLRFGGPMTRSYRSTARTGLPRKTRIILEDENDAMADAD
RLAGPAAAELLAATVSTGFSRSSAINEEDGSSEEGVVINAGKDSTSRELPSATPNTAGSSSTRFIANSQEPEIRL
TSSLPRSPGRSTEDLPGSQATLSQWSTPGSTPSRWPSPSPTAMPSPEDLRLVLMPWGPWHCHCKSGTMSRSRSGK
LHGLSGRLRVGALSQLRTEHKPCTYQQCPCNRLREECPLDTSLCTDTNCASQSTTSTRTTTTPFPTIHLRSSPSL
PPASPCPALAFWKRVRIGLEDIWNSLSSVFTEMQPIDRNQR

FIGURE 225

CCCGGGTCGACCCACGCGTCCGGGGAGAAAGGATGGCCGGCCTGGCGGCGCGGTTGGTCCTGCTAGCTGGGGCAG
CGGCGCTGGCGAGCGGCTCCCAGGGCGACCGTGAGCCGGTGTACCGCGACTGCGTACTGCAGTGCGAAGAGCAGA
ACTGCTCTGGGGGCGCTCTGAATCACTTCCGCTCCCGCCAGCCAATCTACATGAGTCTAGCAGGCTGGACCTGTC
GGGACGACTGTAAGTATGAGTGTATGTGGGTCACCGTTGGGCTCTACCTCCAGGAAGGTCACAAAGTGCCTCAGT
TCCATGGCAAGTGGCCCTTCTCCCGGTTCCTGTTCTTTCAAGAGCCGGCATCGGCCGTGGCCTCGTTTCTCAATG
GCCTGGCCAGCCTGGTGATGCTCTGCCGCTACCGCACCTTCGTGCCAGCCTCCTCCCCCATGTACCACACCTGTG
TGGCCTTCGCCTGGGTGTCCCTCAATGCATGGTTCTGGTCCACAGTCTTCCACACCAGGGACACTGACCTCACAG
AGAAAATGGACTACTTCTGTGCCTCCACTGTCATCCTACACTCAATCTACCTGTGCTGCGTCAGGACCGTGGGGC
TGCAGCACCCAGCTGTGGTCAGTGCCTTCCGGGCTCTCCTGCTGCTCATGCTGACCGTGCACGTCTCCTACCTGA
GCCTCATCCGCTTCGACTATGGCTACAACCTGGTGGCCAACGTGGCTATTGGCCTGGTCAACGTGGTGTGGTGGC
TGGCCTGGTGCCTGTGGAACCAGCGGCGGCTGCCTCACGTGCGCAAGTGCGTGGTGGTGGTCTTGCTGCTGCAGG
GGCTGTCCCTGCTCGAGCTGCTTGACTTCCCACCGCTCTTCTGGGTCCTGGATGCCCATGCCATCTGGCACATCA
GCACCATCCCTGTCCACGTCCTCTTTTTCAGCTTTCTGGAAGATGACAGCCTGTACCTGCTGAAGGAATCAGAGG
ACAAGTTCAAGCTGGACTGAAGACCTTGGAGCGAGTCTGCCCCAGTGGGGATCCTGCCCCCGCCCTGCTGGCCTC
CCTTCTCCCCTCAACCCTTGAGATGATTTTCTCTTTTCAACTTCTTGAACTTGGACATGAAGGATGTGGGCCCAG
AATCATGTGGCCAGCCCACCCCCTGTTGGCCCTCACCAGCCTTGGAGTCTGTTCTAGGGAAGGCCTCCCAGCATC
TGGGACTCGAGAGTGGGCAGCCCCTCTACCTCCTGGAGCTGAACTGGGGTGGAACTGAGTGTGTTCTTAGCTCTA
CCGGGAGGACAGCTGCCTGTTTCCTCCCCACCAGCCTCCTCCCCACATCCCCAGCTGCCTGGCTGGGTCCTGAAG
CCCTCTGTCTACCTGGGAGACCAGGGACCACAGGCCTTAGGGATACAGGGGGTCCCCTTCTGTTACCACCCCCCA
CCCTCCTCCAGGACACCACTAGGTGGTGCTGGATGCTTGTTCTTTGGCCAGCCAAGGTTCACGGCGATTCTCCCC
ATGGGATCTTGAGGGACCAAGCTGCTGGGATTGGGAAGGAGTTTCACCCTGACCGTTGCCCTAGCCAGGTTCCCA
GGAGGCCTCACCATACTCCCTTTCAGGGCCAGGGCTCCAGCAAGCCCAGGGCAAGGATCCTGTGCTGCTGTCTGG
TTGAGAGCCTGCCACCGTGTGTCGGGAGTGTGGGCCAGGCTGAGTGCATAGGTGACAGGGCCGTGAGCATGGGCC
TGGGTGTGTGTGAGCTCAGGCCTAGGTGCGCAGTGTGGAGACGGGTGTTGTCGGGGAAGAGGTGTGGCTTCAAAG
TGTGTGTGTGCAGGGGGTGGGTGTGTTAGCGTGGGTTAGGGGAACGTGTGTGCGCGTGCTGGTGGGCATGTGAGA
TGAGTGACTGCCGGTGAATGTGTCCACAGTTGAGAGGTTGGAGCAGGATGAGGGAATCCTGTCACCATCAATAAT
CACTTGTGGAGCGCCAGCTCTGCCCAAGACGCCACCTGGGCGGACAGCCAGGAGCTCTCCATGGCCAGGCTGCCT
GTGTGCATGTTCCCTGTCTGGTGCCCCTTTGCCCGCCTCCTGCAAACCTCACAGGGTCCCCACACAACAGTGCCC
TCCAGAAGCAGCCCCTCGGAGGCAGAGGAAGGAAAATGGGGATGGCTGGGGCTCTCTCCATCCTCCTTTTCTCCT
TGCCTTCGCATGGCTGGCCTTCCCCTCCAAAACCTCCATTCCCCTGCTGCCAGCCCCTTTGCCATAGCCTGATTT
TGGGGAGGAGGAAGGGGCGATTTGAGGGAGAAGGGGAGAAAGCTTATGGCTGGGTCTGGTTTCTTCCCTTCCCAG
AGGGTCTTACTGTTCCAGGGTGGCCCCAGGGCAGGCAGGGGCCACACTATGCCTGTGCCCTGGTAAAGGTGACCC
CTGCCATTTACCAGCAGCCCTGGCATGTTCCTGCCCCACAGGAATAGAATGGAGGGAGCTCCAGAAACTTTCCAT
CCCAAAGGCAGTCTCCGTGGTTGAAGCAGACTGGATTTTTGCTCTGCCCCTGACCCCTTGTCCCTCTTTGAGGGA
GGGGAGCTATGCTAGGACTCCAACCTCAGGGACTCGGGTGGCCTGCGCTAGCTTCTTTTGATACTGAAAACTTTT
AAGGTGGGAGGGTGGCAAGGGATGTGCTTAATAAATCAATTCCAAGCCTCAAAAAAAAAAAAAAAAA

FIGURE 226

MAGLAARLVLLAGAAALASGSQGDREPVYRDCVLQCEEQNCSGGALNHFRSRQPIYMSLAGWTCRDDCKYECMWV
TVGLYLQEGHKVPQFHGKWPFSRFLFFQEPASAVASFLNGLASLVMLCRYRTFVPASSPMYHTCVAFAWVSLNAW
FWSTVFHTRDTDLTEKMDYFCASTVILHSIYLCCVRTVGLQHPAVVSAFRALLLLMLTVHVSYLSLIRFDYGYNL
VANVAIGLVNVVWWLAWCLWNQRRLPHVRKCVVVVLLLQGLSLLELLDFPPLFWVLDAHAIWHISTIPVHVLFFS
FLEDDSLYLLKESEDKFKLD

Important features:
Signal peptide:
amino acids 1-20

Transmembrane domains:
amino acids 105-123, 138-156, 169-185, 193-209, 221-240, 256-272

N-glycosylation site.
amino acids 40-44

N-myristoylation site.
amino acids 43-49

CUB domain proteins profile.
amino acids 285-302

Amiloride-sensitive sodium channels proteins.
amino acids 162-186

FIGURE 227

TTCGGCTTCCGTAGAGGAAGTGGCGCGGACCTTCATTTGGGGTTTCGGTTCCCCCCCTTCCCCTTCCCCGGGGTC
TGGGGGTGACATTGCACCGCGCCCCTCGTGGGGTCGCGTTGCCACCCCACGCGGACTCCCCAGCTGGCGCGCCCC
TCCCATTTGCCTGTCCTGGTCAGGCCCCCACCCCCCTTCCCACCTGACCAGCCATGGGGGCTGCGGTGTTTTTCG
GCTGCACTTTCGTCGCGTTCGGCCCGGCCTTCGCGCTTTTCTTGATCACTGTGGCTGGGGACCCGCTTCGCGTTA
TCATCCTGGTCGCAGGGGCATTTTTCTGGCTGGTCTCCCTGCTCCTGGCCTCTGTGGTCTGGTTCATCTTGGTCC
ATGTGACCGACCGGTCAGATGCCCGGCTCCAGTACGGCCTCCTGATTTTTGGTGCTGCTGTCTCTGTCCTTCTAC
AGGAGGTGTTCCGCTTTGCCTACTACAAGCTGCTTAAGAAGGCAGATGAAGGGTTAGCATCGCTGAGTGAGGACG
GAAGATCACCCATCTCCATCCGCCAGATGGCCTATGTTTCTGGTCTCTCCTTCGGTATCATCAGTGGTGTCTTCT
CTGTTATCAATATTTTGGCTGATGCACTTGGGCCAGGTGTGGTTGGGATCCATGGAGACTCACCCTATTACTTCC
TGACTTCAGCCTTTCTGACAGCAGCCATTATCCTGCTCCATACCTTTTGGGGAGTTGTGTTCTTTGATGCCTGTG
AGAGGAGACGGTACTGGGCTTTGGGCCTGGTGGTTGGGAGTCACCTACTGACATCGGGACTGACATTCCTGAACC
CCTGGTATGAGGCCAGCCTGCTGCCCATCTATGCAGTCACTGTTTCCATGGGGCTCTGGGCCTTCATCACAGCTG
GAGGGTCCCTCCGAAGTATTCAGCGCAGCCTCTTGTGTAAGGACTGACTACCTGGACTGATCGCCTGACAGATCC
CACCTGCCTGTCCACTGCCCATGACTGAGCCCAGCCCCAGCCCGGGTCCATTGCCCACATTCTCTGTCTCCTTCT
CGTCGGTCTACCCCACTACCTCCAGGGTTTTGCTTTGTCCTTTTGTGACCGTTAGTCTCTAAGCTTTACCAGGAG
CAGCCTGGGTTCAGCCAGTCAGTGACTGGTGGGTTTGAATCTGCACTTATCCCCACCACCTGGGGACCCCCTTGT
TGTGTCCAGGACTCCCCCTGTGTCAGTGCTCTGCTCTCACCCTGCCCAAGACTCACCTCCCTTCCCCTCTGCAGG
CCGACGGCAGGAGGACAGTCGGGTGATGGTGTATTCTGCCCTGCGCATCCCACCCGAGGACTGAGGGAACCTAGG
GGGGACCCCTGGGCCTGGGGTGCCCTCCTGATGTCCTCGCCCTGTATTTCTCCATCTCCAGTTCTGGACAGTGCA
GGTTGCCAAGAAAAGGGACCTAGTTTAGCCATTGCCCTGGAGATGAAATTAATGGAGGCTCAAGGATAGATGAGC
TCTGAGTTTCTCAGTACTCCCTCAAGACTGGACATCTTGGTCTTTTTCTCAGGCCTGAGGGGGAACCATTTTTGG
TGTGATAAATACCCTAAACTGCCTTTTTTTCTTTTTTGAGGTGGGGGGAGGGAGGAGGTATATTGGAACTCTTCT
AACCTCCTTGGGCTATATTTTCTCTCCTCGAGTTGCTCCTCATGGCTGGGCTCATTTCGGTCCCTTTCTCCTTGG
TCCCAGACCTTGGGGGAAAGGAAGGAAGTGCATGTTTGGGAACTGGCATTACTGGAACTAATGGTTTTAACCTCC
TTAACCACCAGCATCCCTCCTCTCCCCAAGGTGAAGTGGAGGGTGCTGTGGTGAGCTGGCCACTCCAGAGCTGCA
GTGCCACTGGAGGAGTCAGACTACCATGACATCGTAGGGAAGGAGGGGAGATTTTTTTGTAGTTTTTAATTGGGG
TGTGGGAGGGGCGGGGAGGTTTTCTATAAACTGTATCATTTTCTGCTGAGGGTGGAGTGTCCCATCCTTTTAATC
AAGGTGATTGTGATTTTGACTAATAAAAAAGAATTTGTAAAAAAAAAAAAAAAAAAAAAAAAAAAAAAAAAAAAA
AAAAAAAAAAAAAAAAAAAAAAAAAAAAAAAAAAAA

FIGURE 228

MGAAVFFGCTFVAFGPAFALFLITVAGDPLRVIILVAGAFFWLVSLLLASVVWFILVHVTDRSDARLQYGLLIFG
AAVSVLLQEVFRFAYYKLLKKADEGLASLSEDGRSPISIRQMAYVSGLSFGIISGVFSVINILADALGPGVVGIH
GDSPYYFLTSAFLTAAIILLHTFWGVVFFDACERRRYWALGLVVGSHLLTSGLTFLNPWYEASLLPIYAVTVSMG
LWAFITAGGSLRSIQRSLLCKD

FIGURE 229

CGGGAGGCTGGGTCGTCATGATCCGGACCCCATTGTCGGCCTCTGCCCATCGCCTGCTCCTCCCAGGCTCCCGCG
GCCGACCCCCGCGCAACATGCAGCCCACGGGCCGCGAGGGTTCCCGCGCGCTCAGCCGGCGGTATCTGCGGCGTC
TGCTGCTCCTGCTACTGCTGCTGCTGCTGCGGCAGCCCGTAACCCGCGCGGAGACCACGCCGGGCGCCCCCAGAG
CCCTCTCCACGCTGGGCTCCCCCAGCCTCTTCACCACGCCGGGTGTCCCCAGCGCCCTCACTACCCCAGGCCTCA
CTACGCCAGGCACCCCCAAAACCCTGGACCTTCGGGGTCGCGCGCAGGCCCTGATGCGGAGTTTCCCACTCGTGG
ACGGCCACAATGACCTGCCCCAGGTCCTGAGACAGCGTTACAAGAATGTGCTTCAGGATGTTAACCTGCGAAATT
TCAGCCATGGTCAGACCAGCCTGGACAGGCTTAGAGACGGCCTCGTGGGTGCCCAGTTCTGGTCAGCCTCCGTCT
CATGCCAGTCCCAGGACCAGACTGCCGTGCGCCTCGCCCTGGAGCAGATTGACCTCATTCACCGCATGTGTGCCT
CCTACTCTGAACTCGAGCTTGTGACCTCAGCTGAAGGTCTGAACAGCTCTCAAAAGCTGGCCTGCCTCATTGGCG
TGNAGGGTGGTCACTCACTGGACAGCAGCCTCTCTGTGCTGCGCAGTTTCTATGTGCTGGGGGTGCGCTACCTGA
CACTTACCTTCACCTGCAGTACACCATGGGCAGAGAGTTCCACCAAGTTCAGACACCACATGTACACCAACGTCA
GCGGATTGACAAGCTTTGGTGAGAAAGTAGTAGAGGAGTTGAACCGCCTGGGCATGATGATAGATTTGTCCTATG
CATCGGACACCTTGATAAGAAGGGTCCTGGAAGTGTCTCAGGCTCCTGTGATCTTCTCCCACTCAGCTGCCAGAG
CTGTGTGTGACAATTTGTTGAATGTTCCCGATGATATCCTGCAGCTTCTGAAGAACGGTGGCATCGTGATGGTGA
CACTGTCCATGGGGGTGCTGCAGTGCAACCTGCTTGCTAACGTGTCCACTGTGGCAGATCACTTTGACCACATCA
GGGCAGTCATTGGATCTGAGTTCATCGGGATTGGTGGAAATTATGACGGGACTGGCCGGTTCCCTCAGGGGCTGG
AGGATGTGTCCACATACCCAGTCCTGATAGAGGAGTTGCTGAGTCGTASCTGGAGCGAGGAAGAGCTTCAAGGTG
TCCTTCGTGGAAACCTGCTGCGGGTCTTCAGACAAGTGGAAAAGGTGAGAGAGGAGAGCAGGGCGCAGAGCCCCG
TGGAGGCTGAGTTTCCATATGGGCAACTGAGCACATCCTGCCACTCCCACCTCGTGCCTCAGAATGGACACCAGG
CTACTCATCTGGAGGTGACCAAGCAGCCAACCAATCGGGTCCCCTGGAGGTCCTCAAATGCCTCCCCATACCTTG
TTCCAGGCCTTGTGGCTGCTGCCACCATCCCAACCTTCACCCAGTGGCTCTGCTGACACAGTCGGTCCCCGCAGA
GGTCACTGTGGCAAAGCCTCACAAAGCCCCCTCTCCTAGTTCATTCACAAGCATATGCTGAGAATAAACATGTTA
CACATGGAAAA

FIGURE 230

></usr/seqdb2/sst/DNA/Dnaseqs.min/ss.DNA59817
><subunit 1 of 1, 487 aa, 1 stop, 2 unknown
><MW: 53569.32, pI: 7.68, NX(S/T): 5
MQPTGREGSRALSRRYLRRLLLLLLLLLLRQPVTRAETTPGAPRALSTLGSPSLFTTPGVPSALTTPGLTTPGTP
KTLDLRGRAQALMRSFPLVDGHNDLPQVLRQRYKNVLQDVNLRNFSHGQTSLDRLRDGLVGAQFWSASVSCQSQD
QTAVRLALEQIDLIHRMCASYSELELVTSAEGLNSSQKLACLIGVXGGHSLDSSLSVLRSFYVLGVRYLTLTFTC
STPWAESSTKFRHHMYTNVSGLTSFGEKVVEELNRLGMMIDLSYASDTLIRRVLEVSQAPVIFSHSAARAVCDNL
LNVPDDILQLLKNGGIVMVTLSMGVLQCNLLANVSTVADHFDHIRAVIGSEFIGIGGNYDGTGRFPQGLEDVSTY
PVLIEELLSRXWSEEELQGVLRGNLLRVFRQVEKVREESRAQSPVEAEFPYGQLSTSCHSHLVPQNGHQATHLEV
TKQPTNRVPWRSSNASPYLVPGLVAAATIPTFTQWLC

Important features of the protein:
Signal peptide:
amino acids 1-36

Transmembrane domain:
amino acids 313-331

N-glycosylation sites.
amino acids 119-122, 184-187, 243-246 and 333-336

N-myristoylation sites.
amino acids 41-46, 59-64, 73-78, 133-138, 182-187, 194-199, 324-329, 354-359, 357-362, 394-399, 427-432 and 472-477.

Prokaryotic membrane lipoprotein lipid attachment site.
amino acids 136-146

FIGURE 231

GCTCTGGCCGGCCCCGGCGATTGGTCACCGCCCGCTAGGGGACAGCCCTGGCCTCCTCTGATTGGCAAGCGCTGG
CCACCTCCCCACACCCCTTGCGAACGCTCCCCTAGTGGAGAAAAGGAGTAGCTATTAGCCAATTCGGCAGGGCCC
GCTTTTTAGAAGCTTGATTTCCTTTGAAGATGAAAGACTAGCGGAAGCTCTGCCTCTTTCCCCAGTGGGCGAGGG
AACTCGGGGCGATTGGCTGGGAACTGTATCCACCCAAATGTCACCGATTTCTTCCTATGCAGGAAATGAGCAGAC
CCATCAATAAGAAATTTCTCAGCCTGGCCGAAAATGGTTGGCCCCACGAAGCCACGACAACTGGAGGCAAAGAGG
GTTGCTCAACGCCCCGCCTCATTGGAAAACCAAATCAGATCTGGGACCTATATAGCGTGGCGGAGGCGGGGCGAT
GATTGTCGCGCTCGCACCCACTGCAGCTGCGCACAGTCGCATTTCTTTCCCCGCCCCTGAGACCCTGCAGCACCA
TCTGTCATGGCGGCTGGGCTGTTTGGTTTGAGCGCTCGCCGTCTTTTGGCGGCAGCGGCGACGCGAGGGCTCCCG
GCCGCCCGCGTCCGCTGGGAATCTAGCTTCTCCAGGACTGTGGTCGCCCCGTCCGCTGTGGCGGGAAAGCGGCCC
CCAGAACCGACCACACCGTGGCAAGAGGACCCAGAACCCGAGGACGAAAACTTGTATGAGAAGAACCCAGACTCC
CATGGTTATGACAAGGACCCCGTTTTGGACGTCTGGAACATGCGACTTGTCTTCTTCTTTGGCGTCTCCATCATC
CTGGTCCTTGGCAGCACCTTTGTGGCCTATCTGCCTGACTACAGGATGAAAGAGTGGTCCCGCCGCGAAGCTGAG
AGGCTTGTGAAATACCGAGAGGCCAATGGCCTTCCCATCATGGAATCCAACTGCTTCGACCCCAGCAAGATCCAG
CTGCCAGAGGATGAGTGACCAGTTGCTAAGTGGGGCTCAAGAAGCACCGCCTTCCCCACCCCCTGCCTGCCATTC
TGACCTCTTCTCAGAGCACCTAATTAAAGGGGCTGAAAGTCTGAA

FIGURE 232

MAAGLFGLSARRLLAAAATRGLPAARVRWESSFSRTVVAPSAVAGKRPPEPTTPWQEDPEPEDENLYEKNPDSHG
YDKDPVLDVWNMRLVFFFGVSIILVLGSTFVAYLPDYRMKEWSRREAERLVKYREANGLPIMESNCFDPSKIQLPEDE

FIGURE 233

GCGGCGGCTATGCCGCTTGCTCTGCTCGTCCTGTTGCTCCTGGGGCCCGGCGGCTGGTGCCTTGCAGAACCCCCA
CGCGACAGCCTGCGGGAGGAACTTGTCATCACCCCGCTGCCTTCCGGGGACGTAGCCGCCACATTCCAGTTCCGC
ACGCGCTGGGATTCGGAGCTTCAGCGGGAAGGAGTGTCCCATTACAGGCTCTTTCCCAAAGCCCTGGGGCAGCTG
ATCTCCAAGTATTCTCTACGGGAGCTGCACCTGTCATTCACACAAGGCTTTTGGAGGACCCGATACTGGGGGCCA
CCCTTCCTGCAGGCCCCATCAGGTGCAGAGCTGTGGGTCTGGTTCCAAGACACTGTCACTGATGTGGATAAATCT
TGGAAGGAGCTCAGTAATGTCCTCTCAGGGATCTTCTGCGCCTCTCTCAACTTCATCGACTCCACCAACACAGTC
ACTCCCACTGCCTCCTTCAAACCCCTGGGTCTGGCCAATGACACTGACCACTACTTTCTGCGCTATGCTGTGCTG
CCGCGGGAGGTGGTCTGCACCGAAAACCTCACCCCCTGGAAGAAGCTCTTGCCCTGTAGTTCCAAGGCAGGCCTC
TCTGTGCTGCTGAAGGCAGATCGCTTGTTCCACACCAGCTACCACTCCCAGGCAGTGCATATCCGCCCTGTTTGC
AGAAATGCACGCTGTACTAGCATCTCCTGGGAGCTGAGGCAGACCCTGTCAGTTGTATTTGATGCCTTCATCACG
GGGCAGGGAAAGAAAGACTGGTCCCTCTTCCGGATGTTCTCCCGAACCCTCACGGAGCCCTGCCCCCTGGCTTCA
GAGAGCCGAGTCTATGTGGACATCACCACCTACAACCAGGACAACGAGACATTAGAGGTGCACCCACCCCCGACC
ACTACATATCAGGACGTCATCCTAGGCACTCGGAAGACCTATGCCATCTATGACTTGCTTGACACCGCCATGATC
AACAACTCTCGAAACCTCAACATCCAGCTCAAGTGGAAGAGACCCCCAGAGAATGAGGCCCCCCCAGTGCCCTTC
CTGCATGCCCAGCGGTACGTGAGTGGCTATGGGCTGCAGAAGGGGGAGCTGAGCACACTGCTGTACAACACCCAC
CCATACCGGGCCTTCCCGGTGCTGCTGCTGGACACCGTACCCTGGTATCTGCGGCTGTATGTGCACACCCTCACC
ATCACCTCCAAGGGCAAGGAGAACAAACCAAGTTACATCCACTACCAGCCTGCCCAGGACCGGCTGCAACCCCAC
CTCCTGGAGATGCTGATTCAGCTGCCGGCCAACTCAGTCACCAAGGTTTCCATCCAGTTTGAGCGGGCGCTGCTG
AAGTGGACCGAGTACACGCCAGATCCTAACCATGGCTTCTATGTCAGCCCATCTGTCCTCAGCGCCCTTGTGCCC
AGCATGGTAGCAGCCAAGCCAGTGGACTGGGAAGAGAGTCCCCTCTTCAACAGCCTGTTCCCAGTCTCTGATGGC
TCTAACTACTTTGTGCGGCTCTACACGGAGCCGCTGCTGGTGAACCTGCCGACACCGGACTTCAGCATGCCCTAC
AACGTGATCTGCCTCACGTGCACTGTGGTGGCCGTGTGCTACGGCTCCTTCTACAATCTCCTCACCCGAACCTTC
CACATCGAGGAGCCCCGCACAGGTGGCCTGGCCAAGCGGCTGGCCAACCTTATCCGGCGCGCCCGAGGTGTCCCC
CCACTCTGATTCTTGCCCTTTCCAGCAGCTGCAGCTGCCGTTTCTCTCTGGGGAGGGGAGCCCAAGGGCTGTTTC
TGCCACTTGCTCTCCTCAGAGTTGGCTTTTGAACCAAAGTGCCCTGGACCAGGTCAGGGCCTACAGCTGTGTTGT
CCAGTACAGGAGCCACGAGCCAAATGTGGCATTTGAATTTGAATTAACTTAGAAATTCATTTCCTCACCTGTAGT
GGCCACCTCTATATTGAGGTGCTCAATAAGCAAAAGTGGTCGGTGGCTGCTGTATTGGACAGCACAGAAAAAGAT
TTCCATCACCACAGAAAGGTCGGCTGGCAGCACTGGCCAAGGTGATGGGGTGTGCTACACAGTGTATGTCACTGT
GTAGTGGATGGAGTTTACTGTTTGTGGAATAAAAACGGCTGTTTCCGTGGAAAAAAAAAAAA

FIGURE 234

MPLALLVLLLLGPGGWCLAEPPRDSLREELVITPLPSGDVAATFQFRTRWDSELQREGVSHYRLFPKALGQLISK
YSLRELHLSFTQGFWRTRYWGPPFLQAPSGAELWVWFQDTVTDVDKSWKELSNVLSGIFCASLNFIDSTNTVTPT
ASFKPLGLANDTDHYFLRYAVLPREVVCTENLTPWKKLLPCSSKAGLSVLLKADRLFHTSYHSQAVHIRPVCRNA
RCTSISWELRQTLSVVFDAFITGQGKKDWSLFRMFSRTLTEPCPLASESRVYVDITTYNQDNETLEVHPPPTTTY
QDVILGTRKTYAIYDLLDTAMINNSRNLNIQLKWKRPPENEAPPVPFLHAQRYVSGYGLQKGELSTLLYNTHPYR
AFPVLLLDTVPWYLRLYVHTLTITSKGKENKPSYIHYQPAQDRLQPHLLEMLIQLPANSVTKVSIQFERALLKWT
EYTPDPNHGFYVSPSVLSALVPSMVAAKPVDWEESPLFNSLFPVSDGSNYFVRLYTEPLLVNLPTPDFSMPYNVI
CLTCTVVAVCYGSFYNLLTRTFHIEEPRTGGLAKRLANLIRRARGVPPL

FIGURE 235

TGACGTCAGAATCACCATGGCCAGCTATCCTTACCGGCAGGGCTGCCCAGGAGCTGCAGGACAAGCACCAGGAGC
CCCTCCGGGTAGCTACTACCCTGGACCCCCCAATAGTGGAGGGCAGTATGGTAGTGGGCTACCCCCTGGTGGTGG
TTATGGGGGTCCTGCCCCTGGAGGGCCTTATGGACCACCAGCTGGTGGAGGGCCCTATGGACACCCCAATCCTGG
GATGTTCCCCTCTGGAACTCCAGGAGGACCATATGGCGGTGCAGCTCCCGGGGGCCCCTATGGTCAGCCACCTCC
AAGTTCCTACGGTGCCCAGCAGCCTGGGCTTTATGGACAGGGTGGCGCCCCTCCCAATGTGGATCCTGAGGCCTA
CTCCTGGTTCCAGTCGGTGGACTCAGATCACAGTGGCTATATCTCCATGAAGGAGCTAAAGCAGGCCCTGGTCAA
CTGCAATTGGTCTTCATTCAATGATGAGACCTGCCTCATGATGATAAACATGTTTGACAAGACCAAGTCAGGCCG
CATCGATGTCTACGGCTTCTCAGCCCTGTGGAAATTCATCCAGCAGTGGAAGAACCTCTTCCAGCAGTATGACCG
GGACCGCTCGGGCTCCATTAGCTACACAGAGCTGCAGCAAGCTCTGTCCCAAATGGGCTACAACCTGAGCCCCCA
GTTCACCCAGCTTCTGGTCTCCCGCTACTGCCCACGCTCTGCCAATCCTGCCATGCAGCTTGACCGCTTCATCCA
GGTGTGCACCCAGCTGCAGGTGCTGACAGAGGCCTTCCGGGAGAAGGACACAGCTGTACAAGGCAACATCCGGCT
CAGCTTCGAGGACTTCGTCACCATGACAGCTTCTCGGATGCTATGACCCAACCATCTGTGGAGAGTGGAGTGCAC
CAGGGACCTTTCCTGGCTTCTTAGAGTGAGAGAAGTATGTGGACATCTCTTCTTTTCCTGTCCCTCTAGAAGAAC
ATTCTCCCTTGCTTGATGCAACACTGTTCCAAAAGAGGGTGGAGAGTCCTGCATCATAGCCACCAAATAGTGAGG
ACCGGGGCTGAGGCCACACAGATAGGGGCCTGATGGAGGAGAGGATAGAAGTTGAATGTCCTGATGGCCATGAGC
AGTTGAGTGGCACAGCCTGGCACCAGGAGCAGGTCCTTGTAATGGAGTTAGTGTCCAGTCAGCTGAGCTCCACCC
TGATGCCAGTGGTGAGTGTTCATCGGCCTGTTACCGTTAGTACCTGTGTTCCCTCACCAGGCCATCCTGTCAAAC
GAGCCCATTTTCTCCAAAGTGGAATCTGACCAAGCATGAGAGAGATCTGTCTATGGGACCAGTGGCTTGGATTCT
GCCACACCCATAAATCCTTGTGTGTTAACTTCTAGCTGCCTGGGGCTGGCCCTGCTCAGACAAATCTGCTCCCTG
GGCATCTTTGGCCAGGCTTCTGCCCCCTGCAGCTGGGACCCCTCACTTGCCTGCCATGCTCTGCTCGGCTTCAGT
CTCCAGGAGACAGTGGTCACCTCTCCCTGCCAATACTTTTTTTAATTTGCATTTTTTTTCATTTGGGGCCAAAAG
TCCAGTGAAATTGTAAGCTTCAATAAAAGGATGAAACTCTGA

FIGURE 236

MASYPYRQGCPGAAGQAPGAPPGSYYPGPPNSGGQYGSGLPPGGGYGGPAPGGPYGPPAGGGPYGHPNPGMFPSG
TPGGPYGGAAPGGPYGQPPPSSYGAQQPGLYGQGGAPPNVDPEAYSWFQSVDSDHSGYISMKELKQALVNCNWSS
FNDETCLMMINMFDKTKSGRIDVYGFSALWKFIQQWKNLFQQYDRDRSGSISYTELQQALSQMGYNLSPQFTQLL
VSRYCPRSANPAMQLDRFIQVCTQLQVLTEAFREKDTAVQGNIRLSFEDFVTMTASRML

Important features of the protein:
Signal peptide:
amino acids 1-19

N-glycosylation site.
amino acids 147-150

Casein kinase II phosphorylation sites.
amino acids 135-138, 150-153, 202-205, 271-274

N-myristoylation sites.
amino acids 9-14, 15-20, 19-24, 33-38, 34-39, 39-44, 43-48, 61-66, 70-75, 78-83, 83-88, 87-92, 110-115

FIGURE 237

```
CAGGATGCAGGGCCGCGTGGCAGGGAGCTGCGCTCCTCTGGGCCTGCTCCTGGTCTGTCTTCATCTCCCAGGCCT
CTTTGCCCGGAGCATCGGTGTTGTGGAGGAGAAAGTTTCCCAAAACTTCGGGACCAACTTGCCTCAGCTCGGACA
ACCTTCCTCCACTGGCCCCTCTAACTCTGAACATCCGCAGCCCGCTCTGGACCCTAGGTCTAATGACTTGGCAAG
GGTTCCTCTGAAGCTCAGCGTGCCTCCATCAGATGGCTTCCCACCTGCAGGAGGTTCTGCAGTGCAGAGGTGGCC
TCCATCGTGGGGGCTGCCTGCCATGGATTCCTGGCCCCTGAGGATCCTTGGCAGATGATGGCTGCTGCGGCTGA
GGACCGCCTGGGGGAAGCGCTGCCTGAAGAACTCTCTTACCTCTCCAGTGCTGCGGCCCTCGCTCCGGGCAGTGG
CCCTTTGCCTGGGGAGTCTTCTCCCGATGCCACAGGCCTCTCACCTGAGGCTTCACTCCTCCACCAGGACTCGGA
GTCCAGACGACTGCCCCGTTCTAATTCACTGGGAGCCGGGGGAAAAATCCTTTCCCAACGCCCTCCCTGGTCTCT
CATCCACAGGGTTCTGCCTGATCACCCCTGGGGTACCCTGAATCCCAGTGTGTCCTGGGGAGGTGGAGGCCCTGG
GACTGGTTGGGGAACGAGGCCCATGCCACACCCTGAGGGAATCTGGGGTATCAATAATCAACCCCCAGGTACCAG
CTGGGGAAATATTAATCGGTATCCAGGAGGCAGCTGGGGAAATATTAATCGGTATCCAGGAGGCAGCTGGGGGAA
TATTAATCGGTATCCAGGAGGCAGCTGGGGGAATATTCATCTATACCCAGGTATCAATAACCCATTTCCTCCTGG
AGTTCTCCGCCCTCCTGGCTCTTCTTGGAACATCCCAGCTGGCTTCCCTAATCCTCCAAGCCCTAGGTTGCAGTG
GGGCTAGAGCACGATAGAGGGAAACCCAACATTGGGAGTTAGAGTCCTGCTCCCGCCCCTTGCTGTGTGGGCTCA
ATCCAGGCCCTGTTAACATGTTTCCAGCACTATCCCCACTTTTCAGTGCCTCCCCTGCTCATCTCCAATAAAATA
AAAGCACTTATGAAAAAAAAAAAAAAAAAAAAAAAAAAAAAAAAAAAAAAAAAAAAAAAAAAAAAAAAAAAAAAA
AAAAAAAAAAAAAAAAAAAAAAAAAAAAAAAAAA
```

FIGURE 238

MQGRVAGSCAPLGLLLVCLHLPGLFARSIGVVEEKVSQNFGTNLPQLGQPSSTGPSNSEHPQPALDPRSNDLARV
PLKLSVPPSDGFPPAGGSAVQRWPPSWGLPAMDSWPPEDPWQMMAAAAEDRLGEALPEELSYLSSAAALAPGSGP
LPGESSPDATGLSPEASLLHQDSESRRLPRSNSLGAGGKILSQRPPWSLIHRVLPDHPWGTLNPSVSWGGGGPGT
GWGTRPMPHPEGIWGINNQPPGTSWGNINRYPGGSWGNINRYPGGSWGNINRYPGGSWGNIHLYPGINNPFPPGV
LRPPGSSWNIPAGFPNPPSPRLQWG

Important features of the protein:
Signal peptide:
amino acids 1-26

Casein kinase II phosphorylation sites.
amino acids 56-59, 155-158

N-myristoylation sites.
amino acids 48-53, 220-225, 221-226, 224-229, 247-252, 258-263, 259-264, 269-274, 270-275, 280-285, 281-286, 305-310

FIGURE 239

GGGCGTCTCCGGCTGCTCCTATTGAGCTGTCTGCTCGCTGTGCCCGCTGTGCCTGCTGTGCCCGCGCTGTCGCCG
CTGCTACCGCGTCTGCTGGACGCGGGAGACGCCAGCGAGCTGGTGATTGGAGCCCTGCGGAGAGCTCAAGCGCCC
AGCTCTGCCCCAGGAGCCCAGGCTGCCCCGTGAGTCCCATAGTTGCTGCAGGAGTGGAGCCATGAGCTGCGTCCT
GGGTGGTGTCATCCCCTTGGGGCTGCTGTTCCTGGTCTGCGGATCCCAAGGCTACCTCCTGCCCAACGTCACTCT
CTTAGAGGAGCTGCTCAGCAAATACCAGCACAACGAGTCTCACTCCCGGGTCCGCAGAGCCATCCCCAGGGAGGA
CAAGGAGGAGATCCTCATGCTGCACAACAAGCTTCGGGGCCAGGTGCAGCCTCAGGCCTCCAACATGGAGTACAT
GGTGAGCGCCGGCTCCGGCCGCAGAGGCTGGCACCGGGGGTGGGGCCTGGGCCACCAGCCTGCTCTGTTCCCCAG
CCAGCTCTGTTCCCCAGCCAGTGCGTGTGATGGCTGGCTCAGGGTCTCCTCTGGCAGGGGAGGATCCCGGCTCTG
TTCTGTTTTGTTTGTTTGTTTTGAGACAGGGTCTCACTCTGCCACTGACGCTGGAGTGCAATGGCACAATCGTCA
TGCCCTGAAACCTTAGACTCCCGGGGTTAAGCGATCCTGCTTCAGCCTCCCAAGTAGCTGGAACTACAGGCATGC
ACCATGGTGCCCAGCTAGATTTTAAATATTTTGTGGAGATGGGGGTCTTGCTACGTTGCCCAGGCTGGTCTTGAA
CTCCTAGGCTCAAGCAATCCTCCTGCCTCAGCCTCTCAAAGTGCTAGGATTATAGGCATGAGTCACCCTGTCTGG
CTCTGGCTCTGTTCTTAACATTCTGCCAAAACAACACACGTGGGTTCCCTGTGCAGAGCCTGCCTCGTTGCCTTC
ATGTCACTCTTGGTAGCTCCACTGGGAACACAGCTCTCAGCCTTTCCCACCTGGAGGCAGAGTGGGGAGGGGCCC
AGGGCTGGGCTTTGCTGATGCTGATCTCAGCTGTGCCACACGCTAGCTGCACCACCCTGACTTCTCCTTAGCCCG
TGTGAGCCTCACTTTCCACTTGGAGAGTCCTTCCTCGCGTGGTTGCCATGACTGTGAGATAAGTCGAGGCTGTGA
AGGGCCCGGCACAGACTGACCTGCCTCCCCAACCCCTAGGCTTTGCTAACCGGGAAAGGAGCTAACGGTGACAGA
AGACAGCCAAGGTCAACCCTCCCGGGTGATTGTGATGGGTGTTCCAGGTGTGGTTGGGCGATGCTGCTACTTGAC
CCCAAGCTCCAGTGTGGAAACTTCCTTCCTGGCTGGTTTTCCAGAACTACAGAGGAATGGACCACAGTCTTCCAG
GGTCCCTCCTCGTCCACCAACCGGGAGCCTCCACCTTGGCCATCCGTCAGCTATGAATGGCTTTTTAAACAAACC
CACGTCCCAGCCTGGGTAACATGGTAAAGCCCCGTCTCTACAAAAAAATCCAAGTTAGCCGGGCATGGTGGTGCG
CACCTGTAGTCCCAGCTGCAGTGGGACTGAGGTGGAGGTGGAGGTGGGGGGTGGGAGCTGAGGAAGGAGGATCGC
TTGAGCCTGGGAAGTCGAGGCTGCAGTGAGCTGAGATTGCACCACTGCACTCCAGCCTGGGTGACAGAGCAAGAC
CCTGTCTCAAAAA

FIGURE 240

MSCVLGGVIPLGLLFLVCGSQGYLLPNVTLLEELLSKYQHNESHSRVRRAIPREDKEEILMLHNKLRGQVQPQAS
NMEYMVSAGSGRRGWHRGWGLGHQPALFPSQLCSPASACDGWLRVSSGRGGSRLCSVLFVCFETGSHSATDAGVQ
WHNRHALKP

Important features:
Signal peptide:
amino acids 1-22

N-glycosylation site.
amino acids 27-31, 41-45

N-myristoylation site.
amino acids 126-132, 140-146

Amidation site.
amino acids 85-89

FIGURE 241

AAGGAGAGGCCACCGGGACTTCAGTGTCTCCTCCATCCCAGGAGCGCAGTGGCCACTATGGGGTCTGGGCTGCCC
CTTGTCCTCCTCTTGACCCTCCTTGGCAGCTCACATGGAACAGGGCCGGGTATGACTTTGCAACTGAAGCTGAAG
GAGTCTTTTCTGACAAATTCCTCCTATGAGTCCAGCTTCCTGGAATTGCTTGAAAAGCTCTGCCTCCTCCTCCAT
CTCCCTTCAGGGACCAGCGTCACCCTCCACCATGCAAGATCTCAACACCATGTTGTCTGCAACACATGACAGCCA
TTGAAGCCTGTGTCCTTCTTGGCCCGGGCTTTTGGGCCGGGGATGCAGGAGGCAGGCCCCGACCCTGTCTTTCAG
CAGGCCCCCACCCTCCTGAGTGGCAATAAATAAAATTCGGTATGCTG

FIGURE 242

MGSGLPLVLLLTLLGSSHGTGPGMTLQLKLKESFLTNSSYESSFLELLEKLCLLLHLPSGTSVTLHHARSQHHVVCNT

FIGURE 243

GGCAAGTGGAACCACTGGCTTGGTGGATTTTGCTAGATTTTTCTGATTTTTAAACTCCTGAAAAATATCCCAGAT
AACTGTCATGAAGCTGGTAACTATCTTCCTGCTGGTGACCATCAGCCTTTGTAGTTACTCTGCTACTGCCTTCCT
CATCAACAAAGTGCCCCTTCCTGTTGACAAGTTGGCACCTTTACCTCTGGACAACATTCTTCCCTTTATGGATCC
ATTAAAGCTTCTTCTGAAAACTCTGGGCATTTCTGTTGAGCACCTTGTGGAGGGGCTAAGGAAGTGTGTAAATGA
GCTGGGACCAGAGGCTTCTGAAGCTGTGAAGAAACTGCTGGAGGCGCTATCACACTTGGTGTGACATCAAGATAA
AGAGCGGAGGTGGATGGGGATGGAAGATGATGCTCCTATCCTCCCTGCCTGAAACCTGTTCTACCAATTATAGAT
CAAATGCCCTAAAATGTAGTGACCCGTGAAAAGGACAAATAAAGCAATGAATACATTA

FIGURE 244

</usr/seqdb2/sst/DNA/Dnaseqs.min/ss.DNA59855
<subunit 1 of 1, 93 aa, 1 stop
<MW: 10161, pI: 7.39, NX(S/T): 0
MKLVTIFLLVTISLCSYSATAFLINKVPLPVDKLAPLPLDNILPFMDPLKLLLKTLGISV
EHLVEGLRKCVNELGPEASEAVKKLLEALSHLV

Important features:
Signal peptide:
Amino acids 1-18

FIGURE 245

TGCTAGGCTCTGTCCCACAATGCACCCGAGAGCAGGAGCTGAAAGCCTCTAACACCCACAGATCCCTCTATGACT
GCAATGTGAGGTGTCCGGCTTTGCTGGCCCAGCAAGCCTGATAAGCATGAAGCTCTTATCTTTGGTGGCTGTGGT
CGGGTGTTTGCTGGTGCCCCCAGCTGAAGCCAACAAGAGTTCTGAAGATATCCGGTGCAAATGCATCTGTCCACC
TTATAGAAACATCAGTGGGCACATTTACAACCAGAATGTATCCCAGAAGGACTGCAACTGCCTGCACGTGGTGGA
GCCCATGCCAGTGCCTGGCCATGACGTGGAGGCCTACTGCCTGCTGTGCGAGTGCAGGTACGAGGAGCGCAGCAC
CACCACCATCAAGGTCATCATTGTCATCTACCTGTCCGTGGTGGGTGCCCTGTTGCTCTACATGGCCTTCCTGAT
GCTGGTGGACCCTCTGATCCGAAAGCCGGATGCATACACTGAGCAACTGCACAATGAGGAGGAGAATGAGGATGC
TCGCTCTATGGCAGCAGCTGCTGCATCCCTCGGGGGACCCCGAGCAAACACAGTCCTGGAGCGTGTGGAAGGTGC
CCAGCAGCGGTGGAAGCTGCAGGTGCAGGAGCAGCGGAAGACAGTCTTCGATCGGCACAAGATGCTCAGCTAGAT
GGGCTGGTGTGGTTGGGTCAAGGCCCCAACACCATGGCTGCCAGCTTCCAGGCTGGACAAAGCAGGGGGCTACTT
CTCCCTTCCCTCGGTTCCAGTCTTCCCTTTAAAAGCCTGTGGCATTTTTCCTCCTTCTCCCTAACTTTAGAAATG
TTGTACTTGGCTATTTTGATTAGGGAAGAGGGATGTGGTCTCTGATCTCTGTTGTCTTCTTGGGTCTTTGGGGTT
GAAGGGAGGGGGAAGGCAGGCCAGAAGGGAATGGAGACATTCGAGGCGGCCTCAGGAGTGGATGCGATCTGTCTC
TCCTGGCTCCACTCTTGCCGCCTTCCAGCTCTGAGTCTTGGGAATGTTGTTACCCTTGGAAGATAAAGCTGGGTC
TTCAGGAACTCAGTGTCTGGGAGGAAAGCATGGCCCAGCATTCAGCATGTGTTCCTTTCTGCAGTGGTTCTTATC
ACCACCTCCCTCCCAGCCCCGGCGCCTCAGCCCCAGCCCCAGCTCCAGCCCTGAGGACAGCTCTGATGGGAGAGC
TGGGCCCCCTGAGCCCACTGGGTCTTCAGGGTGCACTGGAAGCTGGTGTTCGCTGTCCCCTGTGCACTTCTCGCA
CTGGGGCATGGAGTGCCCATGCATACTCTGCTGCCGGTCCCCTCACCTGCACTTGAGGGGTCTGGGCAGTCCCTC
CTCTCCCCAGTGTCCACAGTCACTGAGCCAGACGGTCGGTTGGAACATGAGACTCGAGGCTGAGCGTGGATCTGA
ACACCACAGCCCCTGTACTTGGGTTGCCTCTTGTCCCTGAACTTCGTTGTACCAGTGCATGGAGAGAAAATTTTG
TCCTCTTGTCTTAGAGTTGTGTGTAAATCAAGGAAGCCATCATTAAATTGTTTTATTTCTCTCA

FIGURE 246

</usr/seqdb2/sst/DNA/Dnaseqs.min/ss.DNA60278
<subunit 1 of 1, 183 aa, 1 stop
<MW: 20574, pI: 6.60, NX(S/T): 3
MKLLSLVAVVGCLLVPPAEANKSSEDIRCKCICPPYRNISGHIYNQNVSQKDCNCLHVVEPMPVPGHDVEAYCLL
CECRYEERSTTTIKVIIVIYLSVVGALLLYMAFLMLVDPLIRKPDAYTEQLHNEEENEDARSMAAAAASLGGPRA
NTVLERVEGAQQRWKLQVQEQRKTVFDRHKMLS

Important features:
Signal peptide:
amino acids 1-20

Transmembrane domain:
amino acids 90-112

N-glycosylation sites.
amino acids 21-24, 38-41 and 47-50

FIGURE 247

AATTGTATCTGTGTAATGTTAAAACAAACGAAATAAAATAGAAGGAAAAACTTTCTGAGTTTCAAAAACAACAGA
CTAGTACTCTAAAGAACTCTTTAAAACAATTAACTGTTAGGATTGCAGTTATGATTGGATATTATTTAATTCTGT
TTCTGATGTGGGGTTCCTCCACTGTGTTCTGTGTGCTATTAATATTTACCATTGCAGAAGCTTCATTCAGTGTTG
AAAATGAATGCTTAGTGGATCTGTGCCTCTTACGCATATGTTACAAATTATCTGGAGTTCCTAATCAATGCAGAG
TTCCCCTCCCCTCCGATTGTTCTAAATAATTGAAAGATGTCTGCTGTGGAAAAAGGCATGTATTTAAATCTGTAT
GATTCTCAACCATCTTTAGTTGGGAAAGGTCCTTGAAAGCCAATGGAAATACTTTTTTTTTTTCTTGGCACTAAT
CAAGTGAGTGTTACCTTTTCACTTAGTAGGATGTGTTGTTACGCTAGTAAAATAGAAACCTGTGTTTATTCTCAG
GTATTTTAGAAACAACAGCCATCATTTTATTTTATGTGTGTGTTCTTGGCTGTATTCATAAATTATATATTTTGG
GCTATCAAATATTACTTCATTCAATATAAATAACAATAGTAGAAGTTGTTTACTTAGATATGCTTTCTAGTTGCA
TTTTCTCAGCCTATGTAAGACTACTTTGTTGTAATAGCCTTTGAAATTTACAGTACTGTCTCTCTACTATCTTCA
GATTACTTGATTCAAATAAACCAATTATGTTTGTAATTGATATTAATAAAACCAGAATAAAAGTTCATATCTACCC

FIGURE 248

MIGYYLILFLMWGSSTVFCVLLIFTIAEASFSVENECLVDLCLLRICYKLSGVPNQCRVPLPSDCSK

Important features:
Signal peptide:
amino acids 1-29

FIGURE 249

AGCGGGTCTCGCTTGGGTTCCGCTAATTTCTGTCCTGAGGCGTGAGACTGAGTTCATAGGGTCCTGGGTCCCCGA
ACCAGGAAGGGTTGAGGGAACACAATCTGCAAGCCCCCGCGACCCAAGTGAGGGGCCCCGTGTTGGGGTCCTCCC
TCCCTTTGCATTCCCACCCCTCCGGGCTTTGCGTCTTCCTGGGGACCCCCTCGCCGGGAGATGGCCGCGTTGATG
CGGAGCAAGGATTCGTCCTGCTGCCTGCTCCTACTGGCCGCGGTGCTGATGGTGGAGAGCTCACAGATCGGCAGT
TCGCGGGCCAAACTCAACTCCATCAAGTCCTCTCTGGGCGGGGAGACGCCTGGTCAGGCCGCCAATCGATCTGCG
GGCATGTACCAAGGACTGGCATTCGGCGGCAGTAAGAAGGGCAAAAACCTGGGGCAGGCCTACCCTTGTAGCAGT
GATAAGGAGTGTGAAGTTGGGAGGTATTGCCACAGTCCCCACCAAGGATCATCGGCCTGCATGGTGTGTCGGAGA
AAAAAGAAGCGCTGCCACCGAGATGGCATGTGCTGCCCCAGTACCCGCTGCAATAATGGCATCTGTATCCCAGTT
ACTGAAAGCATCTTAACCCCTCACATCCCGGCTCTGGATGGTACTCGGCACAGAGATCGAAACCACGGTCATTAC
TCAAACCATGACTTGGGATGGCAGAATCTAGGAAGACCACACACTAAGATGTCACATATAAAAGGGCATGAAGGA
GACCCCTGCCTACGATCATCAGACTGCATTGAAGGGTTTTGCTGTGCTCGTCATTTCTGGACCAAAATCTGCAAA
CCAGTGCTCCATCAGGGGGAAGTCTGTACCAAACAACGCAAGAAGGGTTCTCATGGGCTGGAAATTTTCCAGCGT
TGCGACTGTGCGAAGGGCCTGTCTTGCAAAGTATGGAAAGATGCCACCTACTCCTCCAAAGCCAGACTCCATGTG
TGTCAGAAAATTTGATCACCATTGAGGAACATCATCAATTGCAGACTGTGAAGTTGTGTATTTAATGCATTATAG
CATGGTGGAAAATAAGGTTCAGATGCAGAAGAATGGCTAAAATAAGAAACGTGATAAGAATATAGATGATCACAA
AAAGGGAGAAAGAAAACATGAACTGAATAGATTAGAATGGGTGACAAATGCAGTGCAGCCAGTGTTTCCATTATG
CAACTTGTCTATGTAAATAATGTACACATTTGTGGAAAATGCTATTATTAAGAGAACAAGCACACAGTGGAAATT
ACTGATGAGTAGCATGTGACTTTCCAAGAGTTTAGGTTGTGCTGGAGGAGAGGTTTCCTTCAGATTGCTGATTGC
TTATACAAATAACCTACATGCCAGATTTCTATTCAACGTTAGAGTTTAACAAAATACTCCTAGAATAACTTGTTA
TACAATAGGTTCTAAAAATAAAATTGCTAAACAAGAAATGAAAACATGGAGCATTGTTAATTTACAACAGAAAAT
TACCTTTTGATTTGTAACACTACTTCTGCTGTTCAATCAAGAGTCTTGGTAGATAAGAAAAAAATCAGTCAATAT
TTCCAAATAATTGCAAAATAATGGCCAGTTGTTTAGGAAGGCCTTTAGGAAGACAAATAAATAACAAACAAACAG
CCACAAATACTTTTTTTTCAAAATTTAGTTTTACCTGTAATTAATAAGAACTGATACAAGACAAAAACAGTTCC
TTCAGATTCTACGGAATGACAGTATATCTCTCTTTATCCTATGTGATTCCTGCTCTGAATGCATTATATTTTCCA
AACTATACCCATAAATTGTGACTAGTAAAATACTTACACAGAGCAGAATTTTCACAGATGGCAAAAAAATTTAAA
GATGTCCAATATATGTGGGAAAAGAGCTAACAGAGAGATCATTATTTCTTAAAGATTGGCCATAACCTATATTTT
GATAGAATTAGATTGGTAAATACATGTATTCATACATACTCTGTGGTAATAGAGACTTAAGCTGGATCTGTACTG
CACTGGAGTAAGCAAGAAAATTGGGAAAACTTTTTCGTTTGTTCAGGTTTTGGCAACACATAGATCATATGTCTG
AGGCACAAGTTGGCTGTTCATCTTTGAAACCAGGGGATGCACAGTCTAAATGAATATCTGCATGGGATTTGCTAT
CATAATATTTACTATGCAGATGAATTCAGTGTGAGGTCCTGTGTCCGTACTATCCTCAAATTATTTATTTTATAG
TGCTGAGATCCTCAAATAATCTCAATTTCAGGAGGTTTCACAAAATGTACTCCTGAAGTAGACAGAGTAGTGAGG
TTTCATTGCCCTCTATAAGCTTCTGACTAGCCAATGGCATCATCCAATTTTCTTCCCAAACCTCTGCAGCATCTG
CTTTATTGCCAAAGGGCTAGTTTCGGTTTTCTGCAGCCATTGCGGTTAAAAAATATAAGTAGGATAACTTGTAAA
ACCTGCATATTGCTAATCTATAGACACCACAGTTTCTAAATTCTTTGAAACCACTTTACTACTTTTTTTAAACTT
AACTCAGTTCTAAATACTTTGTCTGGAGCACAAAACAATAAAAGGTTATCTTATAGTCGTGACTTTAAACTTTTG
TAGACCACAATTCACTTTTTAGTTTTCTTTTACTTAAATCCCATCTGCAGTCTCAAATTTAAGTTCTCCCAGTAG
AGATTGAGTTTGAGCCTGTATATCTATTAAAAATTTCAACTTCCCACATATATTTACTAAGATGATTAAGACTTA
CATTTTCTGCACAGGTCTGCAAAAACAAAAATTATAAACTAGTCCATCCAAGAACCAAAGTTTGTATAAACAGGT
TGCTATAAGCTTGTGAAATGAAAATGGAACATTTCAATCAAACATTTCCTATATAACAATTATTATATTTACAAT
TTGGTTTCTGCAATATTTTTCTTATGTCCACCCTTTTAAAAATTATTATTTGAAGTAATTTATTTACAGGAAATG
TTAATGAGATGTATTTTCTTATAGAGATATTTCTTACAGAAAGCTTTGTAGCAGAATATATTTGCAGCTATTGAC
TTTGTAATTTAGGAAAAATGTATAATAAGATAAAATCTATTAAATTTTTCTCCTCTAAAAACTGAAAAAAAAAAA
AAAAAAAAAAAAAAAAAAAA

FIGURE 250

MAALMRSKDSSCCLLLLAAVLMVESSQIGSSRAKLNSIKSSLGGETPGQAANRSAGMYQGLAFGGSKKGKNLGQA
YPCSSDKECEVGRYCHSPHQGSSACMVCRRKKKRCHRDGMCCPSTRCNNGICIPVTESILTPHIPALDGTRHRDR
NHGHYSNHDLGWQNLGRPHTKMSHIKGHEGDPCLRSSDCIEGFCCARHFWTKICKPVLHQGEVCTKQRKKGSHGL
EIFQRCDCAKGLSCKVWKDATYSSKARLHVCQKI

Signal peptide:
amino acids 1-25

FIGURE 251

TCTCAATCTGCTGACCTCGTGATCCGCCTGACCTTGTAATCCACCTACCTTGGCCTCCCAAAGTGTTGGGATTAC
AGGCGTGAGCCACCGCGCCCGGCCAACATCACGTTTTTAAAAATTGATTTCTTCAAATTCATGGCAAATATTTCC
CTTCCCTTTAACTTCTTATGTCAGAATGAGGAAGGATAGCTGCATTTATTTAGTCAGTTTTCATTGCATAGTAAT
ATTTTCATGTAGTATTTTCTAAGTTATATTTTAGTAATTCATATGTTTTAGATTATAGGTTTTAACATACTTGTG
AAAATACTTG<u>ATG</u>TGTTTTAAAGCCTTGGGCAGAAATTCTGTATTGTTGAGGATTTGTTCTTTTATCCCCCTTTT
AAAGTCATCCGTCCTTGGCTCAGGATTTGGAGAGCTTGCACCACCAAAAATGGCAAACATCACCAGCTCCCAGAT
TTTGGACCAGTTGAAAGCTCCGAGTTTGGGCCAGTTTACCACCACCCCAAGTACACAGCAGAATAGTACAAGTCA
CCCTACAACTACTACTTCTTGGGACCTCAAGCCCCCAACATCCCAGTCCTCAGTCCTCAGTCATCTTGACTTCAA
ATCTCAACCTGAGCCATCCCCAGTTCTTAGCCAGTTGAGCCAGCGACAACAGCACCAGAGCCAGGCAGTCACTGT
TCCTCCTCCTGGTTTGGAGTCCTTTCCTTCCCAGGCAAAACTTCGAGAATCAACACCTGGAGACAGTCCCTCCAC
TGTGAACAAGCTTTTGCAGCTTCCCAGCACGACCATTGAAAATATCTCTGTGTCTGTCCACCAGCCACAGCCCAA
ACACATCAAACTTGCTAAGCGGCGGATACCCCCAGCTTCTAAGATCCCAGCTTCTGCAGTGGAAATGCCTGGTTC
AGCAGATGTCACAGGATTAAATGTGCAGTTTGGGGCTCTGGAATTTGGGTCAGAACCTTCTCTCTCTGAATTTGG
ATCAGCTCCAAGCAGTGAAAATAGTAATCAGATTCCCATCAGCTTGTATTCGAAGTCTTTAAGTGAGCCTTTGAA
TACATCTTTATCAATGACCAGTGCAGTACAGAACTCCACATATACAACTTCCGTCATTACCTCCTGCAGTCTGAC
AAGCTCATCACTGAATTCTGCTAGTCCAGTAGCAATGTCTTCCTCTTATGACCAGAGTTCTGTGCATAACAGGAT
CCCATACCAAAGCCCTGTGAGTTCATCAGAGTCAGCTCCAGGAACCATCATGAATGGACATGGTGGTGGTCGAAG
TCAGCAGACACTAGACAGTAAGTATAGCAGCAAGCTACTCTTGTCATGGCTGGTGCCAACCAAACAGAGGAAGAG
GATAGCTCACGTGATGTGGAAAACACCAGTTGGTCAATGGCTCATTCGT<u>TAA</u>AAAGCAGCCCTTTTGCTTTTTTG
TTTTTGGACCAGGTGTTGGCTGTGGTGTTATTAGAAATGTCTTAACCACAGCAAGAAGGAGGTGGTGGTCTCATA
TTCTTCTGCCCTAATCAGACTGCACCACAAGTGCAGCATACAGTATGCATTTTAAAGATGCTTGGCCAGGCGGG
GTGGCTGATGCCCATAATCCCAGTGCTTTGGGGGGCCAAGGCAGGCAGATTGCCCAAGCTCAGGAGTTTGAGACC
ACCCTGGGCAACATGGTGAAACTCTGTCTCTACTAAAATACGAAAAACTAGCCGGGTGTGGTGGCGGCGCGTGCC
TGTAATCCCAGCTACTTGGGAGGCTGAGGCACAAGAATCGCTTGAGCCAGCTTGGGCTACAAAGTGAGACTCCGT
CTGAAAAGA

FIGURE 252

MCFKALGRNSVLLRICSFIPLLKSSVLGSGFGELAPPKMANITSSQILDQLKAPSLGQFTTTPSTQQNSTSHPTT
TTSWDLKPPTSQSSVLSHLDFKSQPEPSPVLSQLSQRQQHQSQAVTVPPPGLESFPSQAKLRESTPGDSPSTVNK
LLQLPSTTIENISVSVHQPQPKHIKLAKRRIPPASKIPASAVEMPGSADVTGLNVQFGALEFGSEPSLSEFGSAP
SSENSNQIPISLYSKSLSEPLNTSLSMTSAVQNSTYTTSVITSCSLTSSSLNSASPVAMSSSYDQSSVHNRIPYQ
SPVSSSESAPGTIMNGHGGGRSQQTLDSKYSSKLLLSWLVPTKQRKRIAHVMWKTPVGQWLIR

Signal peptide:
amino acids 1-24

FIGURE 253

GGGCGCCCGCGTACTCACTAGCTGAGGTGGCAGTGGTTCCACCAACATGGAGCTCTCGCAGATGTCGGAGCTCAT
GGGGCTGTCGGTGTTGCTTGGGCTGCTGGCCCTGATGGCGACGGCGGCGGTAGCGCGGGGGTGGCTGCGCGCGGG
GGAGGAGAGGAGCGGCCGGCCCGCCTGCCAAAAAGCAAATGGATTTCCACCTGACAAATCTTCGGGATCCAAGAA
GCAGAAACAATATCAGCGGATTCGGAAGGAGAAGCCTCAACAACACAACTTCACCCACCGCCTCCTGGCTGCAGC
TCTGAAGAGCCACAGCGGGAACATATCTTGCATGGACTTTAGCAGCAATGGCAAATACCTGGCTACCTGTGCAGA
TGATCGCACCATCCGCATCTGGAGCACCAAGGACTTCCTGCAGCGAGAGCACCGCAGCATGAGAGCCAACGTGGA
GCTGGACCACGCCACCCTGGTGCGCTTCAGCCCTGACTGCAGAGCCTTCATCGTCTGGCTGGCCAACGGGGACAC
CCTCCGTGTCTTCAAGATGACCAAGCGGGAGGATGGGGGCTACACCTTCACAGCCACCCCAGAGGACTTCCCTAA
AAAGCACAAGGCGCCTGTCATCGACATTGGCATTGCTAACACAGGGAAGTTTATCATGACTGCCTCCAGTGACAC
CACTGTCCTCATCTGGAGCCTGAAGGGTCAAGTGCTGTCTACCATCAACACCAACCAGATGAACAACACACACGC
TGCTGTATCTCCCTGTGGCAGATTTGTAGCCTCGTGTGGCTTCACCCCAGATGTGAAGGTTTGGGAAGTCTGCTT
TGGAAAGAAGGGGGAGTTCCAGGAGGTGGTGCGAGCCTTCGAACTAAAGGGCCACTCCGCGGCTGTGCACTCGTT
TGCTTTCTCCAACGACTCACGGAGGATGGCTTCTGTCTCCAAGGATGGTACATGGAAACTGTGGACACAGATGT
GGAATACAAGAAGAAGCAGGACCCCTACTTGCTGAAGACAGGCCGCTTTGAAGAGGCGGCGGGTGCCGCGCCGTG
CCGCCTGGCCCTCTCCCCCAACGCCCAGGTCTTGGCCTTGGCCAGTGGCAGTAGTATTCATCTCTACAATACCCG
GCGGGGCGAGAAGGAGGAGTGCTTTGAGCGGGTCCATGGCGAGTGTATCGCCAACTTGTCCTTTGACATCACTGG
CCGCTTTCTGGCCTCCTGTGGGGACCGGGCGGTGCGGCTGTTTCACAACACTCCTGGCCACCGAGCCATGGTGGA
GGAGATGCAGGGCCACCTGAAGCGGGCCTCCAACGAGAGCACCCGCCAGAGGCTGCAGCAGCAGCTGACCCAGGC
CCAAGAGACCCTGAAGAGCCTGGGTGCCCTGAAGAAGTGACTCTGGGAGGGCCCGGCGCAGAGGATTGAGGAGGA
GGGATCTGGCCTCCTCATGGCACTGCTGCCATCTTTCCTCCCAGGTGGAAGCCTTTCAGAAGGAGTCTCCTGGTT
TTCTTACTGGTGGCCCTGCTTCTTCCCATTGAAACTACTCTTGTCTACTTAGGTCTCTCTCTTCTTGCTGGCTGT
GACTCCTCCCTGACTAGTGGCCAAGGTGCTTTTCTTCCTCCCAGGCCCAGTGGGTGGAATCTGTCCCCACCTGGC
ACTGAGGAGAATGGTAGAGAGGAGAGGAGAGAGAGAGAGAATGTGATTTTTGGCCTTGTGGCAGCACATCCTCAC
ACCCAAAGAAGTTTGTAAATGTTCCAGAACAACCTAGAGAACACCTGAGTACTAAGCAGCAGTTTTGCAAGGATG
GGAGACTGGGATAGCTTCCCATCACAGAACTGTGTTCCATCAAAAAGACACTAAGGGATTTCCTTCTGGGCCTCA
GTTCTATTTGTAAGATGGAGAATAATCCTCTCTGTGAACTCCTTGCAAAGATGATATGAGGCTAAGAGAATATCA
AGTCCCCAGGTCTGGAAGAAAAGTAGAAAAGAGTAGTACTATTGTCCAATGTCATGAAAGTGGTAAAAGTGGGAA
CCAGTGTGCTTTGAAACCAAATTAGAAACACATTCCTTGGGAAGGCAAAGTTTTCTGGGACTTGATCATACATTT
TATATGGTTGGGACTTCTCTCTTCGGGAGATGATATCTTGTTTAAGGAGACCTCTTTTCAGTTCATCAAGTTCAT
CAGATATTTGAGTGCCCACTCTGTGCCCAAATAAATATGAGCTGGGGATTAAAAAAAAAAAAAAAAAAAAAAAAA
AAAAAAAAAAAAAAAAAAAAAAAAAAAAAAA

FIGURE 254

MELSQMSELMGLSVLLGLLALMATAAVARGWLRAGEERSGRPACQKANGFPPDKSSGSKKQKQYQRIRKEKPQQH
NFTHRLLAAALKSHSGNISCMDFSSNGKYLATCADDRTIRIWSTKDFLQREHRSMRANVELDHATLVRFSPDCRA
FIVWLANGDTLRVFKMTKREDGGYTFTATPEDFPKKHKAPVIDIGIANTGKFIMTASSDTTVLIWSLKGQVLSTI
NTNQMNNTHAAVSPCGRFVASCGFTPDVKVWEVCFGKKGEFQEVVRAFELKGHSAAVHSFAFSNDSRRMASVSKD
GTWKLWDTDVEYKKKQDPYLLKTGRFEEAAGAAPCRLALSPNAQVLALASGSSIHLYNTRRGEKEECFERVHGEC
IANLSFDITGRFLASCGDRAVRLFHNTPGHRAMVEEMQGHLKRASNESTRQRLQQQLTQAQETLKSLGALKK

Important features:
Signal peptide:
amino acids 1-25

N-glycosylation site.
amino acids 76-80, 92-96, 231-235, 289-293, 378-382, 421-425

Beta-transducin family Trp-Asp repeat protein.
amino acids 30-47, 105-118, 107-119, 203-216, 205-217, 296-308

FIGURE 255

ACGGACCGAGGGTTCGAGGGAGGGACACGGACCAGGAACCTGAGCTAGGTCAAAGACGCCCGGGCCAGGTGCCCC
GTCGCAGGTGCCCCTGGCCGGAGATGCGGTAGGAGGGGCGAGCGCGAGAAGCCCCTTCCTCGGCGCTGCCAACCC
GCCACCCAGCCCATGGCGAACCCCGGGCTGGGGCTGCTTCTGGCGCTGGGCCTGCCGTTCCTGCTGGCCCGCTGG
GGCCGAGCCTGGGGGCAAATACAGACCACTTCTGCAAATGAGAATAGCACTGTTTTGCCTTCATCCACCAGCTCC
AGCTCCGATGGCAACCTGCGTCCGGAAGCCATCACTGCTATCATCGTGGTCTTCTCCCTCTTGGCTGCCTTGCTC
CTGGCTGTGGGGCTGGCACTGTTGGTGCGGAAGCTTCGGGAGAAGCGGCAGACGGAGGGCACCTACCGGCCCAGT
AGCGAGGAGCAGTTCTCCCATGCAGCCGAGGCCCGGGCCCCTCAGGACTCCAAGGAGACGGTGCAGGGCTGCCTG
CCCATCTAGGTCCCCTCTCCTGCATCTGTCTCCCTTCATTGCTGTGTGACCTTGGGGAAAGGCAGTGCCCTCTCT
GGGCAGTCAGATCCACCCAGTGCTTAATAGCAGGGAAGAAGGTACTTCAAAGACTCTGCCCCTGAGGTCAAGAGA
GGATGGGGCTATTCACTTTTATATATTTATATAAAATTAGTAGTGAGATGTAAAAAAAAAAAAAAAAA

FIGURE 256

MANPGLGLLLALGLPFLLARWGRAWGQIQTTSANENSTVLPSSTSSSSDGNLRPEAITAIIVVFSLLAALLLAVG
LALLVRKLREKRQTEGTYRPSSEEQFSHAAEARAPQDSKETVQGCLPI

FIGURE 257

GCCAGGAATAACTAGAGAGGAACAATGGGGTTATTCAGAGGTTTTGTTTTCCTCTTAGTTCTGTGCCTGCTGCAC
CAGTCAAATACTTCCTTCATTAAGCTGAATAATAATGGCTTTGAAGATATTGTCATTGTTATAGATCCTAGTGTG
CCAGAAGATGAAAAAATAATTGAACAAATAGAGGATATGGTGACTACAGCTTCTACGTACCTGTTTGAAGCCACA
GAAAAAAGATTTTTTTTCAAAAATGTATCTATATTAATTCCTGAGAATTGGAAGGAAAATCCTCAGTACAAAAGG
CCAAAACATGAAAACCATAAACATGCTGATGTTATAGTTGCACCACCTACACTCCCAGGTAGAGATGAACCATAC
ACCAAGCAGTTCACAGAATGTGGAGAGAAAGGCGAATACATTCACTTCACCCCTGACCTTCTACTTGGAAAAAAA
CAAAATGAATATGGACCACCAGGCAAACTGTTTGTCCATGAGTGGGCTCACCTCCGGTGGGGAGTGTTTGATGAG
TACAATGAAGATCAGCCTTTCTACCGTGCTAAGTCAAAAAAAATCGAAGCAACAAGGTGTTCCGCAGGTATCTCT
GGTAGAAATAGAGTTTATAAGTGTCAAGGAGGCAGCTGTCTTAGTAGAGCATGCAGAATTGATTCTACAACAAAA
CTGTATGGAAAAGATTGTCAATTCTTTCCTGATAAAGTACAAACAGAAAAAGCATCCATAATGTTTATGCAAAGT
ATTGATTCTGTTGTTGAATTTTGTAACGAAAAAACCCATAATCAAGAAGCTCCAAGCCTACAAAACATAAAGTGC
AATTTTAGAAGTACATGGGAGGTGATTAGCAATTCTGAGGATTTTAAAAACACCATACCCATGGTGACACCACCT
CCTCCACCTGTCTTCTCATTGCTGAAGATCAGTCAAAGAATTGTGTGCTTAGTTCTTGATAAGTCTGGAAGCATG
GGGGGTAAGGACCGCCTAAATCGAATGAATCAAGCAGCAAAACATTTCCTGCTGCAGACTGTTGAAAATGGATCC
TGGGTGGGGATGGTTCACTTTGATAGTACTGCCACTATTGTAAATAAGCTAATCCAAATAAAAAGCAGTGATGAA
AGAAACACACTCATGGCAGGATTACCTACATATCCTCTGGGAGGAACTTCCATCTGCTCTGGAATTAAATATGCA
TTTCAGGTGATTGGAGAGCTACATTCCCAACTCGATGGATCCGAAGTACTGCTGCTGACTGATGGGGAGGATAAC
ACTGCAAGTTCTTGTATTGATGAAGTGAAACAAAGTGGGGCCATTGTTCATTTTATTGCTTTGGGAAGAGCTGCT
GATGAAGCAGTAATAGAGATGAGCAAGATAACAGGAGGAAGTCATTTTTATGTTTCAGATGAAGCTCAGAACAAT
GGCCTCATTGATGCTTTTGGGGCTCTTACATCAGGAAATACTGATCTCTCCCAGAAGTCCCTTCAGCTCGAAAGT
AAGGGATTAACACTGAATAGTAATGCCTGGATGAACGACACTGTCATAATTGATAGTACAGTGGGAAAGGACACG
TTCTTTCTCATCACATGGAACAGTCTGCCTCCCAGTATTTCTCTCTGGGATCCCAGTGGAACAATAATGGAAAAT
TTCACAGTGGATGCAACTTCCAAAATGGCCTATCTCAGTATTCCAGGAACTGCAAAGGTGGGCACTTGGGCATAC
AATCTTCAAGCCAAAGCGAACCCAGAAACATTAACTATTACAGTAACTTCTCGAGCAGCAAATTCTTCTGTGCCT
CCAATCACAGTGAATGCTAAAATGAATAAGGACGTAAACAGTTTCCCCAGCCCAATGATTGTTTACGCAGAAATT
CTACAAGGATATGTACCTGTTCTTGGAGCCAATGTGACTGCTTTCATTGAATCACAGAATGGACATACAGAAGTT
TTGGAACTTTTGGATAATGGTGCAGGCGCTGATTCTTTCAAGAATGATGGAGTCTACTCCAGGTATTTTACAGCA
TATACAGAAAATGGCAGATATAGCTTAAAAGTTCGGGCTCATGGAGGAGCAAACACTGCCAGGCTAAAATTACGG
CCTCCACTGAATAGAGCCGCGTACATACCAGGCTGGGTAGTGAACGGGGAAATTGAAGCAAACCCGCCAAGACCT
GAAATTGATGAGGATACTCAGACCACCTTGGAGGATTTCAGCCGAACAGCATCCGGAGGTGCATTTGTGGTATCA
CAAGTCCCAAGCCTTCCCTTGCCTGACCAATACCCACCAAGTCAAATCACAGACCTTGATGCCACAGTTCATGAG
GATAAGATTATTCTTACATGGACAGCACCAGGAGATAATTTTGATGTTGGAAAAGTTCAACGTTATATCATAAGA
ATAAGTGCAAGTATTCTTGATCTAAGAGACAGTTTTGATGATGCTCTTCAAGTAAATACTACTGATCTGTCACCA
AAGGAGGCCAACTCCAAGGAAAGCTTTGCATTTAAACCAGAAAATATCTCAGAAGAAAATGCAACCCACATATTT
ATTGCCATTAAAAGTATAGATAAAAGCAATTTGACATCAAAAGTATCCAACATTGCACAAGTAACTTTGTTTATC
CCTCAAGCAAATCCTGATGACATTGATCCTACACCTACTCCTACTCCTACTCCTACTCCTGATAAAAGTCATAAT
TCTGGAGTTAATATTTCTACGCTGGTATTGTCTGTGATTGGGTCTGTTGTAATTGTTAACTTTATTTTAAGTACC
ACCATTTGAACCTTAACGAAGAAAAAAATCTTCAAGTAGACCTAGAAGAGAGTTTTAAAAAACAAAACAATGTAA
GTAAAGGATATTTCTGAATCTTAAAATTCATCCCATGTGTGATCATAAACTCATAAAAATAATTTTAAGATGTCG
GAAAAGGATACTTTGATTAAATAAAAACACTCATGGATATGTAAAAACTGTCAAGATTAAAATTTAATAGTTTCA
TTTATTTGTTATTTTATTTGTAAGAAATAGTGATGAACAAAGATCCTTTTTCATACTGATACCTGGTTGTATATT
ATTTGATGCAACAGTTTTCTGAAATGATATTTCAAATTGCATCAAGAAATTAAAATCATCTATCTGAGTAGTCAA
AATACAAGTAAAGGAGAGCAAATAAACAACATTTGGAAAAAAAAAAAAAAAAAAAAAAAAAAAAAAAAAAAAAAA
AAAAAAAAAAAAAAAAAAAAAAAAAAAAAAAAAAAAAAA

FIGURE 258

MGLFRGFVFLLVLCLLHQSNTSFIKLNNNGFEDIVIVIDPSVPEDEKIIEQIEDMVTTASTYLFEATEKRFFFKN
VSILIPENWKENPQYKRPKHENHKHADVIVAPPTLPGRDEPYTKQFTECGEKGEYIHFTPDLLLGKKQNEYGPPG
KLFVHEWAHLRWGVFDEYNEDQPFYRAKSKKIEATRCSAGISGRNRVYKCQGGSCLSRACRIDSTTKLYGKDCQF
FPDKVQTEKASIMFMQSIDSVVEFCNEKTHNQEAPSLQNIKCNFRSTWEVISNSEDFKNTIPMVTPPPPPVFSLL
KISQRIVCLVLDKSGSMGGKDRLNRMNQAAKHFLLQTVENGSWVGMVHFDSTATIVNKLIQIKSSDERNTLMAGL
PTYPLGGTSICSGIKYAFQVIGELHSQLDGSEVLLLTDGEDNTASSCIDEVKQSGAIVHFIALGRAADEAVIEMS
KITGGSHFYVSDEAQNNGLIDAFGALTSGNTDLSQKSLQLESKGLTLNSNAWMNDTVIIDSTVGKDTFFLITWNS
LPPSISLWDPSGTIMENFTVDATSKMAYLSIPGTAKVGTWAYNLQAKANPETLTITVTSRAANSSVPPITVNAKM
NKDVNSFPSPMIVYAEILQGYVPVLGANVTAFIESQNGHTEVLELLDNGAGADSFKNDGVYSRYFTAYTENGRYS
LKVRAHGGANTARLKLRPPLNRAAYIPGWVVNGEIEANPPRPEIDEDTQTTLEDFSRTASGGAFVVSQVPSLPLP
DQYPPSQITDLDATVHEDKIILTWTAPGDNFDVGKVQRYIIRISASILDLRDSFDDALQVNTTDLSPKEANSKES
FAFKPENISEENATHIFIAIKSIDKSNLTSKVSNIAQVTLFIPQANPDDIDPTPTPTPTPTPDKSHNSGVNISTL
VLSVIGSVVIVNFILSTTI

Signal peptide:
amino acids 1-21

Putative transmembrane domains:
amino acids 284-300, 617-633

Leucine zipper pattern.
amino acids 469-491, 476-498

N-glycosylation site.
amino acids 20-24, 75-79, 340-344, 504-508, 542-546, 588-592, 628-632, 811-815, 832-836, 837-841, 852-856, 896-900

FIGURE 259

CGCCGGAGGCAGCGGCGGCGTGGCGCAGCGGCGACATGGCCGTTGTCTCAGAGGACGACTTTCAGCACAGTTCAA
ACTCCACCTACGGAACCACAAGCAGCAGTCTCCGAGCTGACCAGGAGGCACTGCTTGAGAAGCTGCTGGACCGCC
CGCCCCCTGGCCTGCAGAGGCCCGAGGACCGCTTCTGTGGCACATACATCATCTTCTTCAGCCTGGGCATTGGCA
GTCTACTGCCATGGAACTTCTTTATCACTGCCAAGGAGTACTGGATGTTCAAACTCCGCAACTCCTCCAGCCCAG
CCACCGGGGAGGACCCTGAGGGCTCAGACATCCTGAACTACTTTGAGAGCTACCTTGCCGTTGCCTCCACCGTGC
CCTCCATGCTGTGCCTGGTGGCCAACTTCCTGCTTGTCAACAGGGTTGCAGTCCACATCCGTGTCCTGGCCTCAC
TGACGGTCATCCTGGCCATCTTCATGGTGATAACTGCACTGGTGAAGGTGGACACTTCCTCCTGGACCCGTGGTT
TTTTTGCGGTCACCATTGTCTGCATGGTGATCCTCAGCGGTGCCTCCACTGTCTTCAGCAGCAGCATCTACGGCA
TGACCGGCTCCTTTCCTATGAGGAACTCCCAAGCACTGATATCAGGAGGAGCCATGGGCGGGACGGTCAGCGCCG
TGGCCTCATTGGTGGACTTGGCTGCATCCAGTGATGTGAGGAACAGCGCCCTGGCCTTCTTCCTGACGGCCACCA
TCTTCCTCGTGCTCTGCATGGGACTCTACCTGCTGCTGTCCAGGCTGGAGTATGCCAGGTACTACATGAGGCCTG
TTCTTGCGGCCCATGTGTTTTCTGGTGAAGAGGAGCTTCCCCAGGACTCCCTCAGTGCCCCTTCGGTGGCCTCCA
GATTCATTGATTCCCACACACCCCCTCTCCGCCCCATCCTGAAGAAGACGGCCAGCCTGGGCTTCTGTGTCACCT
ACGTCTTCTTCATCACCAGCCTCATCTACCCCGCCGTCTGCACCAACATCGAGTCCCTCAACAAGGGCTCGGGCT
CACTGTGGACCACCAAGTTTTTCATCCCCCTCACTACCTTCCTCCTGTACAACTTTGCTGACCTATGTGGCCGGC
AGCTCACCGCCTGGATCCAGGTGCCAGGGCCCAACAGCAAGGCGCTCCCAGGGTTCGTGCTCCTCCGGACCTGCC
TCATCCCCCTCTTCGTGCTCTGTAACTACCAGCCCCGCGTCCACCTGAAGACTGTGGTCTTCCAGTCCGATGTGT
ACCCCGCACTCCTCAGCTCCCTGCTGGGGCTCAGCAACGGCTACCTCAGCACCCTGGCCCTCCTCTACGGGCCTA
AGATTGTGCCCAGGGAGCTGGCTGAGGCCACGGGAGTGGTGATGTCCTTTTATGTGTGCTTGGGCTTAACACTGG
GCTCAGCCTGCTCTACCCTCCTGGTGCACCTCATCTAGAAGGGAGGACACAAGGACATTGGTGCTTCAGAGCCTT
TGAAGATGAGAAGAGAGTGCAGGAGGGCTGGGGGCCATGGAGGAAAGGCCTAAAGTTTCACTTGGGGACAGAGAG
CAGAGCACACTCGGGCCTCATCCCTCCCAAGATGCCAGTGAGCCACGTCCATGCCCATTCCGTGCAAGGCAGATA
TTCCAGTCATATTAACAGAACACTCCTGAGACAGTTGAAGAAGAAATAGCACAAATCAGGGGTACTCCCTTCACA
GCTGATGGTTAACATTCCACCTTCTTTCTAGCCCTTCAAAGATGCTGCCAGTGTTCGCCCTAGAGTTATTACAAA
GCCAGTGCCAAAACCCAGCCATGGGCTCTTTGCAACCTCCCAGCTGCGCTCATTCCAGCTGACAGCGAGATGCAA
GCAAATGCTCAGCTCTCCTTACCCTGAAGGGGTCTCCCTGGAATGGAAGTCCCCTGGCATGGTCAGTCCTCAGGC
CCAAGACTCAAGTGTGCACAGACCCCTGTGTTCTGCGGGTGAACAACTGCCCACTAACCAGACTGGAAAACCCAG
AAAGATGGGCCTTCCATGAATGCTTCATTCCAGAGGGACCAGAGGGCCTCCCTGTGCAAGGGATCAAGCATGTCT
GGCCTGGGTTTTCAAAAAAAGAGGGATCCTCATGACCTGGTGGTCTATGGCCTGGGTCAAGATGAGGGTCTTTCA
GTGTTCCTGTTTACAACATGTCAAAGCCATTGGTTCAAGGGCGTAATAAATACTTGCGTATTCAAAAA

FIGURE 260

MAVVSEDDFQHSSNSTYGTTSSSLRADQEALLEKLLDRPPPGLQRPEDRFCGTYIIFFSLGIGSLLPWNFFITAK
EYWMFKLRNSSSPATGEDPEGSDILNYFESYLAVASTVPSMLCLVANFLLVNRVAVHIRVLASLTVILAIFMVIT
ALVKVDTSSWTRGFFAVTIVCMVILSGASTVFSSSIYGMTGSFPMRNSQALISGGAMGGTVSAVASLVDLAASSD
VRNSALAFFLTATIFLVLCMGLYLLLSRLEYARYYMRPVLAAHVFSGEEELPQDSLSAPSVASRFIDSHTPPLRP
ILKKTASLGFCVTYVFFITSLIYPAVCTNIESLNKGSGSLWTTKFFIPLTTFLLYNFADLCGRQLTAWIQVPGPN
SKALPGFVLLRTCLIPLFVLCNYQPRVHLKTVVFQSDVYPALLSSLLGLSNGYLSTLALLYGPKIVPRELAEATG
VVMSFYVCLGLTLGSACSTLLVHLI

Transmembrane domain:
amino acids 50-74 (type II), 105-127, 135-153, 163-183, 228-252, 305-330, 448-472

FIGURE 261

CGGACGCGTGGGCTGCTGGTGGGAAGGCCTAAAGAACTGGAAAGCCCACTCTCTTGGAACCACCACACCTGTTTA
AAGAACCTAAGCACCATTTAAAGCCACTGGAAATTTGTTGTCTAGTGGTTGTGGGTGAATAAAGGAGGGCAGA<u>AT</u>
<u>G</u>GATGATTTCATCTCCATTAGCCTGCTGTCTCTGGCTATGTTGGTGGGATGTTACGTGGCCGGAATCATTCCCTT
GGCTGTTAATTTCTCAGAGGAACGACTGAAGCTGGTGACTGTTTTGGGTGCTGGCCTTCTCTGTGGAACTGCTCT
GGCAGTCATCGTGCCTGAAGGAGTACATGCCCTTTATGAAGATATTCTTGAGGGAAAACACCACCAAGCAAGTGA
AACACATAATGTGATTGCATCAGACAAAGCAGCAGAAAAATCAGTTGTCCATGAACATGAGCACAGCCACGACCA
CACACAGCTGCATGCCTATATTGGTGTTTCCCTCGTTCTGGGCTTCGTTTTCATGTTGCTGGTGGACCAGATTGG
TAACTCCCATGTGCATTCTACTGACGATCCAGAAGCAGCAAGGTCTAGCAATTCCAAAATCACCACCACGCTGGG
TCTGGTTGTCCATGCTGCAGCTGATGGTGTTGCTTTGGGAGCAGCAGCATCTACTTCACAGACCAGTGTCCAGTT
AATTGTGTTTGTGGCAATCATGCTACATAAGGCACCAGCTGCTTTTGGACTGGTTTCCTTCTTGATGCATGCTGG
CTTAGAGCGGAATCGAATCAGAAAGCACTTGCTGGTCTTTGCATTGGCAGCACCAGTTATGTCCATGGTGACATA
CTTAGGACTGAGTAAGAGCAGTAAAGAAGCCCTTTCAGAGGTGAACGCCACGGGAGTGGCCATGCTTTTCTCTGC
CGGGACATTTCTTTATGTTGCCACAGTACATGTCCTCCCTGAGGTGGGCGGAATAGGGCACAGCCACAAGCCCGA
TGCCACGGGAGGGAGAGGCCTCAGCCGCCTGGAAGTGGCAGCCCTGGTTCTGGGTTGCCTCATCCCTCTCATCCT
GTCAGTAGGACACCAGCAT<u>TAA</u>ATGTTCAAGGTCCAGCCTTGGTCCAGGGCCGTTTGCCATCCAGTGAGAACAGC
CGGCACGTGACAGCTACTCACTTCCTCAGTCTCTTGTCTCACCTTGCGCATCTCTACATGTATTCCTAGAGTCCA
GAGGGGAGGTGAGGTTAAAACCTGAGTAATGGAAAAGCTTTTAGAGTAGAAACACATTTACGTTGCAGTTAGCTA
TAGACATCCCATTGTGTTATCTTTTAAAAGGCCCTTGACATTTTGCGTTTTAATATTTCTCTTAACCCTATTCTC
AGGGAAGATGGAATTTAGTTTTAAGGAAAAGAGGAGAACTTCATACTCACAATGAAATAGTGATTATGAAAATAC
AGTGTTCTGTAATTAAGCTATGTCTCTTTCTTCTTAGTTTAGAGGCTCTGCTACTTTATCCATTGATTTTTAACA
TGGTTCCCACCATGTAAGACTGGTGCTTTAGCATCTATGCCACATGCGTTGATGGAAGGTCATAGCACCCACTCA
CTTAGATGCTAAAGGTGATTCTAGTTAATCTGGGATTAGGGTCAGGAAAATGATAGCAAGACACATTGAAAGCTC
TCTTTATACTCAAAAGAGATATCCATTGAAAAGGGATGTCTAGAGGGATTTAAACAGCTCCTTTGGCACGTGCCT
CTCTGAATCCAGCCTGCCATTCCATCAAATGGAGCAGGAGAGGTGGGAGGAGCTTCTAAAGAGGTGACTGGTATT
TTGTAGCATTCCTTGTCAAGTTCTCCTTTGCAGAATACCTGTCTCCACATTCCTAGAGAGGAGCCAAGTTCTAGT
AGTTTCAGTTCTAGGCTTTCCTTCAAGAACAGTCAGATCACAAAGTGTCTTTGGAAATTAAGGGATATTAAATTT
TAAGTGATTTTTGGATGGTTATTGATATCTTTGTAGTAGCTTTTTTTAAAAGACTACCAAAATGTATGGTTGTCC
TTTTTTTTTGTTTTTTTTTTTTTTAATTATTTCTCTTAGCAGATCAGCAATCCCTCTAGGGACCTAAATACTAGG
TCAGCTTTGGCGACACTGTGTCTTCTCACATAACCACCTGTAGCAAGATGGATCATAAATGAGAAGTGTTTGCCT
ATTGATTTAAAGCTTATTGGAATCATGTCTCTTGTCTCTTCGTCTTTTCTTTGCTTTTCTTCTAACTTTTCCCTC
TAGCCTCTCCTCGCCACAATTTGCTGCTTACTGCTGGTGTTAATATTTGTGTGGGATGAATTCTTATCAGGACAA
CCACTTCTCGAACTGTAATAATGAAGATAATAATATCTTTATTCTTTATCCCCCTTCAAAGAAATTACCTTTGTG
TCAAATGCCGCTTTGTTGAGCCCTTAAAATACCACCTCCTCATGTGTAAATTGACACAATCACTAATCTGGTAAT
TTAAACAATTGAGATAGCAAAAGTGTTTAACAGACTAGGATAATTTTTTTTTCATATTTGCCAAAATTTTTGTAA
ACCCTGTCTTGTCAAATAAGTGTATAATATTGTATTATTAATTTATTTTTACTTTCTATACCATTTCAAAACACA
TTACACTAAGGGGGAACCAAGACTAGTTTCTTCAGGGCAGTGGACGTAGTAGTTTGTAAAAACGTTTTCTATGAC
GCATAAGCTAGCATGCCTATGATTTATTTCCTTCATGAATTTGTCACTGGATCAGCAGCTGTGGAAATAAAGCTT
GTGAGCCCTCTGCTGGCCACAGTGAGGAAAGTAGCACAAATAGGATACAGTTGTATGTAGTCATTGGCAACAATT
GCATACAATTTTACTACCAAGAGAAGGTATAGTATGGAAAGTCCAAATGACTTCCTTGATTGGATGTTAACAGCT
GACTGGTGTGAGACTTGAGGTTTCATCTAGTCCTTCAAAACTATATGGTTGCCTAGATTCTCTCTGGAAACTGAC
TTTGTCAAATAAATAGCAGATTGTAGTGTCAAAAAAAA

FIGURE 262

MDDFISISLLSLAMLVGCYVAGIIPLAVNFSEERLKLVTVLGAGLLCGTALAVIVPEGVHALYEDILEGKHHQAS
ETHNVIASDKAAEKSVVHEHEHSHDHTQLHAYIGVSLVLGFVFMLLVDQIGNSHVHSTDDPEAARSSNSKITTTL
GLVVHAAADGVALGAAASTSQTSVQLIVFVAIMLHKAPAAFGLVSFLMHAGLERNRIRKHLLVFALAAPVMSMVT
YLGLSKSSKEALSEVNATGVAMLFSAGTFLYVATVHVLPEVGGIGHSHKPDATGGRGLSRLEVAALVLGCLIPLI
LSVGHQH

Signal peptide:
amino acids 1-18

Transmembrane domain:
amino acids 37-56, 106-122, 211-230, 240-260, 288-304

FIGURE 263

CTCCTTAGGTGGAAACCCTGGGAGTAGAGTACTGACAGCAAAGACCGGGAAAGACCATACGTCCCCGG
GCAGGGGTGACAACAGGTGTCATCTTTTTGATCTCGTGTGTGGCTGCCTTCCTATTTCAAGGAAAGAC
GCCAAGGTAATTTTGACCCAGAGGAGCAATGATGTAGCCACCTCCTAACCTTCCCTTCTTGAACCCCC
AGTTATGCCAGGATTTACTAGAGAGTGTCAACTCAACCAGCAAGCGGCTCCTTCGGCTTAACTTGTGG
TTGGAGGAGAGAACCTTTGTGGGGCTGCGTTCTCTTAGCAGTGCTCAGAAGTGACTTGCCTGAGGGTG
GACCAGAAGAAAGGAAAGGTCCCCTCTTGCTGTTGGCTGCACATCAGGAAGGCTGTGATGGGAATGAA
GGTGAAAACTTGGAGATTTCACTTCAGTCATTGCTTCTGCCTGCAAGATCATCCTTTAAAAGTAGAGA
AGCTGCTCTGTGTGGTGGTTAACTCCAAGAGGCAGAACTCGTTCTAGAAGGAAATGGATGCAAGCAGC
TCCGGGGGCCCCAAACGCATGCTTCCTGTGGTCTAGCCCAGGGAAGCCCTTCCGTGGGGGCCCCGGCT
TTGAGGGATGCCACCGGTTCTGGACGCATGGCTGATTCCTGAATGATGATGGTTCGCCGGGGGCTGCT
TGCGTGGATTTCCCGGGTGGTGGTTTTGCTGGTGCTCCTCTGCTGTGCTATCTCTGTCCTGTACATGT
TGGCCTGCACCCCAAAAGGTGACGAGGAGCAGCTGGCACTGCCCAGGGCCAACAGCCCCACGGGGAAG
GAGGGGTACCAGGCCGTCCTTCAGGAGTGGGAGGAGCAGCACCGCAACTACGTGAGCAGCCTGAAGCG
GCAGATCGCACAGCTCAAGGAGGAGCTGCAGGAGAGGAGTGAGCAGCTCAGGAATGGGCAGTACCAAG
CCAGCGATGCTGCTGGCCTGGGTCTGGACAGGAGCCCCCCAGAGAAAACCCAGGCCGACCTCCTGGCC
TTCCTGCACTCGCAGGTGGACAAGGCAGAGGTGAATGCTGGCGTCAAGCTGGCCACAGAGTATGCAGC
AGTGCCTTTCGATAGCTTTACTCTACAGAAGGTGTACCAGCTGGAGACTGGCCTTACCCGCCACCCCG
AGGAGAAGCCTGTGAGGAAGGACAAGCGGGATGAGTTGGTGGAAGCCATTGAATCAGCCTTGGAGACC
CTGAACAATCCTGCAGAGAACAGCCCCAATCACCGTCCTTACACGGCCTCTGATTTCATAGAAGGGAT
CTACCGAACAGAAAGGGACAAAGGGACATTGTATGAGCTCACCTTCAAAGGGGACCACAAACACGAAT
TCAAACGGCTCATCTTATTTCGACCATTCAGCCCCATCATGAAAGTGAAAAATGAAAAGCTCAACATG
GCCAACACGCTTATCAATGTTATCGTGCCTCTAGCAAAAAGGGTGGACAAGTTCCGGCAGTTCATGCA
GAATTTCAGGGAGATGTGCATTGAGCAGGATGGGAGAGTCCATCTCACTGTTGTTTACTTTGGGAAAG
AAGAAATAAATGAAGTCAAAGGAATACTTGAAAACACTTCCAAAGCTGCCAACTTCAGGAACTTTACC
TTCATCCAGCTGAATGGAGAATTTTCTCGGGGAAAGGGACTTGATGTTGGAGCCCGCTTCTGGAAGGG
AAGCAACGTCCTTCTCTTTTTCTGTGATGTGGACATCTACTTCACATCTGAATTCCTCAATACGTGTA
GGCTGAATACACAGCCAGGGAAGAAGGTATTTTATCCAGTTCTTTTCAGTCAGTACAATCCTGGCATA
ATATACGGCCACCATGATGCAGTCCCTCCCTTGGAACAGCAGCTGGTCATAAAGAAGGAAACTGGATT
TTGGAGAGACTTTGGATTTGGGATGACGTGTCAGTATCGGTCAGACTTCATCAATATAGGTGGGTTTG
ATCTGGACATCAAAGGCTGGGGCGGAGAGGATGTGCACCTTTATCGCAAGTATCTCCACAGCAACCTC
ATAGTGGTACGGACGCCTGTGCGAGGACTCTTCCACCTCTGGCATGAGAAGCGCTGCATGGACGAGCT
GACCCCCGAGCAGTACAAGATGTGCATGCAGTCCAAGGCCATGAACGAGGCATCCCACGGCCAGCTGG
GCATGCTGGTGTTCAGGCACGAGATAGAGGCTCACCTTCGCAAACAGAAACAGAAGACAAGTAGCAAA
AAAACATGAACTCCCAGAGAAGGATTGTGGGAGACACTTTTTCTTTCCTTTTGCAATTACTGAAAGTG
GCTGCAACAGAGAAAAGACTTCCATAAAGGACGACAAAAGAATTGGACTGATGGGTCAGAGATGAGAA
AGCCTCCGATTTCTCTCTGTTGGGCTTTTTACAACAGAAATCAAAATCTCCGCTTTGCCTGCAAAAGT
AACCCAGTTGCACCCTGTGAAGTGTCTGACAAAGGCAGAATGCTTGTGAGATTATAAGCCTAATGGTG
TGGAGGTTTTGATGGTGTTTACAATACACTGAGACCTGTTGTTTTGTGTGCTCATTGAAATATTCATG
ATTTAAGAGCAGTTTTGTAAAAAATTCATTAGCATGAAAGGCAAGCATATTTCTCCTCATATGAATGA
GCCTATCAGCAGGGCTCTAGTTTCTAGGAATGCTAAAATATCAGAAGGCAGGAGAGGAGATAGGCTTA
TTATGATACTAGTGAGTACATTAAGTAAAATAAAATGGACCAGAAAAGAAAAGAAACCATAAATATCG
TGTCATATTTTCCCCAAGATTAACCAAAAATAATCTGCTTATCTTTTTGGTTGTCCTTTTAACTGTCT
CCGTTTTTTTCTTTTATTTAAAAATGCACTTTTTTTCCCTTGTGAGTTATAGTCTGCTTATTTAATTA
CCACTTTGCAAGCCTTACAAGAGAGCACAAGTTGGCCTACATTTTTATATTTTTTAAGAAGATACTTT
GAGATGCATTATGAGAACTTTCAGTTCAAAGCATCAAATTGATGCCATATCCAAGGACATGCCAAATG
CTGATTCTGTCAGGCACTGAATGTCAGGCATTGAGACATAGGGAAGGAATGGTTTGTACTAATACAGA
CGTACAGATACTTTCTCTGAAGAGTATTTTCGAAGAGGAGCAACTGAACACTGGAGGAAAAGAAAATG
ACACTTTCTGCTTTACAGAAAAGGAAACTCATTCAGACTGGTGATATCGTGATGTACCTAAAAGTCAG
AAACCACATTTTCTCCTCAGAAGTAGGGACCGCTTTCTTACCTGTTTAAATAAACCAAAGTATACCGT
GTGAACCAAACAATCTCTTTTCAAAACAGGGTGCTCCTCCTGGCTTCTGGCTTCCATAAGAAGAAATG
GAGAAAAATATATATATATATATATATATTGTGAAAGATCAATCCATCTGCCAGAATCTAGTGGGATG
GAAGTTTTTGCTACATGTTATCCACCCCAGGCCAGGTGGAAGTAACTGAATTATTTTTTAAATTAAGC
AGTTCTACTCAATCACCAAGATGCTTCTGAAAATTGCATTTTATTACCATTTCAAACTATTTTTTAAA
AATAAATACAGTTAACATAGAGTGGTTTCTTCATTCATGTGAAAATTATTAGCCAGCACCAGATGCAT
GAGCTAATTATCTCTTTGAGTCCTTGCTTCTGTTTGCTCACAGTAAACTCATTGTTTAAAAGCTTCAA
GAACATTCAAGCTGTTGGTGTGTTAAAAAATGCATTGTATTGATTTGTACTGGTAGTTTATGAAATTT
AATTAAAACACAGGCCATGAATGGAAGGTGGTATTGCACAGCTAATAAAATATGATTTGTGGATATGAA

FIGURE 264

MMMVRRGLLAWISRVVVLLVLLCCAISVLYMLACTPKGDEEQLALPRANSPTGKEGYQAVLQEWEEQHRNYVSSL
KRQIAQLKEELQERSEQLRNGQYQASDAAGLGLDRSPPEKTQADLLAFLHSQVDKAEVNAGVKLATEYAAVPFDS
FTLQKVYQLETGLTRHPEEKPVRKDKRDELVEAIESALETLNNPAENSPNHRPYTASDFIEGIYRTERDKGTLYE
LTFKGDHKHEFKRLILFRPFSPIMKVKNEKLNMANTLINVIVPLAKRVDKFRQFMQNFREMCIEQDGRVHLTVVY
FGKEEINEVKGILENTSKAANFRNFTFIQLNGEFSRGKGLDVGARFWKGSNVLLFFCDVDIYFTSEFLNTCRLNT
QPGKKVFYPVLFSQYNPGIIYGHHDAVPPLEQQLVIKKETGFWRDFGFGMTCQYRSDFINIGGFDLDIKGWGGED
VHLYRKYLHSNLIVVRTPVRGLFHLWHEKRCMDELTPEQYKMCMQSKAMNEASHGQLGMLVFRHEIEAHLRKQKQ
KTSSKKT

FIGURE 265

GGATGCAGAAAGCCTCAGTGTTGCTCTTCCTGGCCTGGGTCTGCTTCCTCTTCTACGCTGGCATTGCCCTCTTCA
CCAGTGGCTTCCTGCTCACCCGTTTGGAGCTCACCAACCATAGCAGCTGCCAAGAGCCCCCAGGCCCTGGGTCCC
TGCCATGGGGGAGCCAAGGGAAACCTGGGGCCTGCTGGATGGCTTCCCGATTTTCGCGGGTTGTGTTGGTGCTGA
TAGATGCTCTGCGATTTGACTTCGCCCAGCCCCAGCATTCACACGTGCCTAGAGAGCCTCCTGTCTCCCTACCCT
TCCTGGGCAAACTAAGCTCCTTGCAGAGGATCCTGGAGATTCAGCCCCACCATGCCCGGCTCTACCGATCTCAGG
TTGACCCTCCTACCACCACCATGCAGCGCCTCAAGGCCCTCACCACTGGCTCACTGCCTACCTTTATTGATGCTG
GTAGTAACTTCGCCAGCCACGCCATAGTGGAAGACAATCTCATTAAGCAGCTCACCAGTGCAGGAAGGCGTGTAG
TCTTCATGGGAGATGATACCTGGAAAGACCTTTTCCCTGGTGCTTTCTCCAAAGCTTTCTTCTTCCCATCCTTCA
ATGTCAGAGACCTAGACACAGTGGACAATGGCATCCTGGAACACCTCTACCCCACCATGGACAGTGGTGAATGGG
ACGTGCTGATTGCTCACTTCCTGGGTGTGGACCACTGTGGCCACAAGCATGGCCCTCACCACCCTGAAATGGCCA
AGAAACTTAGCCAGATGGACCAGGTGATCCAGGGACTTGTGGAGCGTCTGGAGAATGACACACTGCTGGTAGTGG
CTGGGGACCATGGGATGACCACAAATGGAGACCATGGAGGGGACAGTGAGCTGGAGGTCTCAGCTGCTCTCTTTC
TGTATAGCCCCACAGCAGTCTTCCCCAGCACCCCACCAGAGGAGCCAGAGGTGATTCCTCAAGTTAGCCTTGTGC
CCACGCTGGCCCTGCTGCTGGGCCTGCCCATCCCATTTGGGAATATCGGGGAAGTGATGGCTGAGCTATTCTCAG
GGGGTGAGGACTCCCAGCCCCACTCCTCTGCTTTAGCCCAAGCCTCAGCTCTCCATCTCAATGCTCAGCAGGTGT
CCCGATTTCTTCATACCTACTCAGCTGCTACTCAGGACCTTCAAGCTAAGGAGCTTCATCAGCTGCAGAACCTCT
TCTCCAAGGCCTCTGCTGACTACCAGTGGCTTCTCCAGAGCCCCAAGGGGGCTGAGGCGACACTGCCGACTGTGA
TTGCTGAGCTGCAGCAGTTCCTGCGGGGAGCTCGGGCCATGTGCATCGAGTCTTGGGCTCGTTTCTCTCTGGTCC
GCATGGCGGGGGGTACTGCTCTCTTGGCTGCTTCCTGCTTTATCTGCCTGCTGGCATCTCAGTGGGCAATATCCC
CAGGCTTTCCATTCTGCCCTCTACTCCTGACACCTGTGGCCTGGGGCCTGGTTGGGGCCATAGCGTATGCTGGAC
TCCTGGGAACTATTGAGCTGAAGCTAGATCTAGTGCTTCTAGGGGCTGTGGCTGCAGTGAGCTCATTCCTCCCTT
TTCTGTGGAAAGCCTGGGCTGGCTGGGGGTCCAAGAGGCCCCTGGCAACCCTGTTTCCCATCCCTGGGCCCGTCC
TGTTACTCCTGCTGTTTCGCTTGGCTGTGTTCTTCTCTGATAGTTTTGTTGTAGCTGAGGCCAGGGCCACCCCCT
TCCTTTTGGGCTCATTCATCCTGCTCCTGGTTGTCCAGCTTCACTGGGAGGGCCAGCTGCTTCCACCTAAGCTAC
TCACAATGCCCCGCCTTGGCACTTCAGCCACAACAAACCCCCCACGGCACAATGGTGCATATGCCCTGAGGCTTG
GAATTGGGTTGCTTTTATGTACAAGGCTAGCTGGGCTTTTTCATCGTTGCCCTGAAGAGACACCTGTTTGCCACT
CCTCTCCCTGGCTGAGTCCTCTGGCATCCATGGTGGGTGGTCGAGCCAAGAATTTATGGTATGGAGCTTGTGTGG
CGGCGCTGGTGGCCCTGTTAGCTGCCGTGCGCTTGTGGCTTCGCCGCTATGGTAATCTCAAGAGCCCCGAGCCAC
CCATGCTCTTTGTGCGCTGGGGACTGCCCCTAATGGCATTGGGTACTGCTGCCTACTGGGCATTGGCGTCGGGGG
CAGATGAGGCTCCCCCCCGTCTCCGGGTCCTGGTCTCTGGGGCATCCATGGTGCTGCCTCGGGCTGTAGCAGGGC
TGGCTGCTTCAGGGCTCGCGCTGCTGCTCTGGAAGCCTGTGACAGTGCTGGTGAAGGCTGGGGCAGGCGCTCCAA
GGACCAGGACTGTCCTCACTCCCTTCTCAGGCCCCCCCACTTCTCAAGCTGACTTGGATTATGTGGTCCCTCAAA
TCTACCGACACATGCAGGAGGAGTTCCGGGGCCGGTTAGAGAGGACCAAATCTCAGGGTCCCCTGACTGTGGCTG
CTTATCAGTTGGGGAGTGTCTACTCAGCTGCTATGGTCACAGCCCTCACCCTGTTGGCCTTCCCACTTCTGCTGT
TGCATGCGGAGCGCATCAGCCTTGTGTTCCTGCTTCTGTTTCTGCAGAGCTTCCTTCTCCTACATCTGCTTGCTG
CTGGGATACCCGTCACCACCCCTGGTCCTTTTACTGTGCCATGGCAGGCAGTCTCGGCTTGGGCCCTCATGGCCA
CACAGACCTTCTACTCCACAGGCCACCAGCCTGTCTTTCCAGCCATCCATTGGCATGCAGCCTTCGTGGGATTCC
CAGAGGGTCATGGCTCCTGTACTTGGCTGCCTGCTTTGCTAGTGGGAGCCAACACCTTTGCCTCCCACCTCCTCT
TTGCAGTAGGTTGCCCACTGCTCCTGCTCTGGCCTTTCCTGTGTGAGAGTCAAGGGCTGCGGAAGAGACAGCAGC
CCCCAGGGAATGAAGCTGATGCCAGAGTCAGACCCGAGGAGGAAGAGGAGCCACTGATGGAGATGCGGCTCCGGG
ATGCGCCTCAGCACTTCTATGCAGCACTGCTGCAGCTGGGCCTCAAGTACCTCTTTATCCTTGGTATTCAGATTC
TGGCCTGTGCCTTGGCAGCCTCCATCCTTCGCAGGCATCTCATGGTCTGGAAAGTGTTTGCCCCTAAGTTCATAT
TTGAGGCTGTGGGCTTCATTGTGAGCAGCGTGGGACTTCTCCTGGGCATAGCTTTGGTGATGAGAGTGGATGGTG
CTGTGAGCTCCTGGTTCAGGCAGCTATTTCTGGCCCAGCAGAGGTAGCCTAGTCTGTGATTACTGGCACTTGGCT
ACAGAGAGTGCTGGAGAACAGTGTAGCCTGGCCTGTACAGGTACTGGATGATCTGCAAGACAGGCTCAGCCATAC
TCTTACTATCATGCAGCCAGGGGCCGCTGACATCTAGGACTTCATTATTCTATAATTCAGGACCACAGTGGAGTA
TGATCCCTAACTCCTGATTTGGATGCATCTGAGGGACAAGGGGGGCGGTCTCCGAAGTGGAATAAAATAGGCCGG
GCGTGGTGACTTGCACCTATAATCCCAGCACTTTGGGAGGCAGAGGTGGGAGGATTGCTTGGTCCCAGGAGTTCA
AGACCAGCCTGTGGAACATAACAAGACCCCGTCTCTACTATTTAAAAAAAAGTGTAATAAAATGATAATAT

FIGURE 266

</usr/seqdb2/sst/DNA/Dnaseqs.min/ss.DNA62809
<subunit 1 of 1, 1089 aa, 1 stop
<MW: 118699, pI: 8.49, NX(S/T): 2
MQKASVLLFLAWVCFLFYAGIALFTSGFLLTRLELTNHSSCQEPPGPGSLPWGSQGKPGACWMASRFSRVVLVLI
DALRFDFAQPQHSHVPREPPVSLPFLGKLSSLQRILEIQPHHARLYRSQVDPPTTTMQRLKALTTGSLPTFIDAG
SNFASHAIVEDNLIKQLTSAGRRVVFMGDDTWKDLFPGAFSKAFFFPSFNVRDLDTVDNGILEHLYPTMDSGEWD
VLIAHFLGVDHCGHKHGPHHPEMAKKLSQMDQVIQGLVERLENDTLLVVAGDHGMTTNGDHGGDSELEVSAALFL
YSPTAVFPSTPPEEPEVIPQVSLVPTLALLLGLPIPFGNIGEVMAELFSGGEDSQPHSSALAQASALHLNAQQVS
RFLHTYSAATQDLQAKELHQLQNLFSKASADYQWLLQSPKGAEATLPTVIAELQQFLRGARAMCIESWARFSLVR
MAGGTALLAASCFICLLASQWAISPGFPFCPLLLTPVAWGLVGAIAYAGLLGTIELKLDLVLLGAVAAVSSFLPF
LWKAWAGWGSKRPLATLFPIPGPVLLLLLFRLAVFFSDSFVVAEARATPFLLGSFILLLVVQLHWEGQLLPPKLL
TMPRLGTSATTNPPRHNGAYALRLGIGLLLCTRLAGLFHRCPEETPVCHSSPWLSPLASMVGGRAKNLWYGACVA
ALVALLAAVRLWLRRYGNLKSPEPPMLFVRWGLPLMALGTAAYWALASGADEAPPRLRVLVSGASMVLPRAVAGL
AASGLALLLWKPVTVLVKAGAGAPRTRTVLTPFSGPPTSQADLDYVVPQIYRHMQEEFRGRLERTKSQGPLTVAA
YQLGSVYSAAMVTALTLLAFPLLLLHAERISLVFLLLFLQSFLLLHLLAAGIPVTTPGPFTVPWQAVSAWALMAT
QTFYSTGHQPVFPAIHWHAAFVGFPEGHGSCTWLPALLVGANTFASHLLFAVGCPLLLLWPFLCESQGLRKRQQP
PGNEADARVRPEEEEEPLMEMRLRDAPQHFYAALLQLGLKYLFILGIQILACALAASILRRHLMVWKVFAPKFIF
EAVGFIVSSVGLLLGIALVMRVDGAVSSWFRQLFLAQQR

Important features:
Signal peptide:
amino acids 1-16

Transmembrane domains:
amino acids 317-341, 451-470, 481-500, 510-527, 538-555, 831-850, 1016-1034, 1052-1070

Leucine zipper pattern.
amino acids 843-864

N-glycosylation sites.
amino acids 37-40, 268-271

FIGURE 267

GAGACTGCAGAGGGAGATAAAGAGAGAGGGCAAAGAGGCAGCAAGAGATTTGTCCTGGGGATCCAGAAACCCATG
ATACCCTACTGAACACCGAATCCCCTGGAAGCCCACAGAGACAGAGACAGCAAGAGAAGCAGAGATAAATACACT
CACGCCAGGAGCTCGCTCGCTCTCTCTCTCTCTCTCACTCCTCCCTCCCTCTCTCTCTGCCTGTCCTAGTCCT
CTAGTCCTCAAATTCCCAGTCCCCTGCACCCCTTCCTGGGACACTATGTTGTTCTCCGCCCTCCTGCTGGAGGTG
ATTTGGATCCTGGCTGCAGATGGGGGTCAACACTGGACGTATGAGGGCCCACATGGTCAGGACCATTGGCCAGCC
TCTTACCCTGAGTGTGGAAACAATGCCCAGTCGCCCATCGATATTCAGACAGACAGTGTGACATTTGACCCTGAT
TTGCCTGCTCTGCAGCCCCACGGATATGACCAGCCTGGCACCGAGCCTTTGGACCTGCACAACAATGGCCACACA
GTGCAACTCTCTCTGCCCTCTACCCTGTATCTGGGTGGACTTCCCCGAAAATATGTAGCTGCCCAGCTCCACCTG
CACTGGGGTCAGAAAGGATCCCCAGGGGGGTCAGAACACCAGATCAACAGTGAAGCCACATTTGCAGAGCTCCAC
ATTGTACATTATGACTCTGATTCCTATGACAGCTTGAGTGAGGCTGCTGAGAGGCCTCAGGGCCTGGCTGTCCTG
GGCATCCTAATTGAGGTGGGTGAGACTAAGAATATAGCTTATGAACACATTCTGAGTCACTTGCATGAAGTCAGG
CATAAAGATCAGAAGACCTCAGTGCCTCCCTTCAACCTAAGAGAGCTGCTCCCCAAACAGCTGGGGCAGTACTTC
CGCTACAATGGCTCGCTCACAACTCCCCCTTGCTACCAGAGTGTGCTCTGGACAGTTTTTTATAGAAGGTCCCAG
ATTTCAATGGAACAGCTGGAAAAGCTTCAGGGGACATTGTTCTCCACAGAAGAGGAGCCCTCTAAGCTTCTGGTA
CAGAACTACCGAGCCCTTCAGCCTCTCAATCAGCGCATGGTCTTTGCTTCTTTCATCCAAGCAGGATCCTCGTAT
ACCACAGGTGAAATGCTGAGTCTAGGTGTAGGAATCTTGGTTGGCTGTCTCTGCCTTCTCCTGGCTGTTTATTTC
ATTGCTAGAAAGATTCGGAAGAAGAGGCTGGAAAACCGAAAGAGTGTGGTCTTCACCTCAGCACAAGCCACGACT
GAGGCATAAATTCCTTCTCAGATACCATGGATGTGGATGACTTCCCTTCATGCCTATCAGGAAGCCTCTAAAATG
GGGTGTAGGATCTGGCCAGAAACACTGTAGGAGTAGTAAGCAGATGTCCTCCTTCCCCTGGACATCTCTTAGAGA
GGAATGGACCCAGGCTGTCATTCCAGGAAGAACTGCAGAGCCTTCAGCCTCTCCAAACATGTAGGAGGAAATGAG
GAAATCGCTGTGTTGTTAATGCAGAGANCAAACTCTGTTTAGTTGCAGGGGAAGTTTGGGATATACCCCAAAGTC
CTCTACCCCCTCACTTTTATGGCCCTTTCCCTAGATATACTGCGGGATCTCTCCTTAGGATAAAGAGTTGCTGTT
GAAGTTGTATATTTTTGATCAATATATTTGGAAATTAAAGTTTCTGACTTT

FIGURE 268

></usr/seqdb2/sst/DNA/Dnaseqs.min/ss.DNA62812
><subunit 1 of 1, 337 aa, 1 stop
><MW: 37668, pI: 6.27, NX(S/T): 1
MLFSALLLEVIWILAADGGQHWTYEGPHGQDHWPASYPECGNNAQSPIDIQTDSVTFDPDLPALQPHGYDQPGTE
PLDLHNNGHTVQLSLPSTLYLGGLPRKYVAAQLHLHWGQKGSPGGSEHQINSEATFAELHIVHYDSDSYDSLSEA
AERPQGLAVLGILIEVGETKNIAYEHILSHLHEVRHKDQKTSVPPFNLRELLPKQLGQYFRYNGSLTTPPCYQSV
LWTVFYRRSQISMEQLEKLQGTLFSTEEEPSKLLVQNYRALQPLNQRMVFASFIQAGSSYTTGEMLSLGVGILVG
CLCLLLAVYFIARKIRKKRLENRKSVVFTSAQATTEA

Important features of the protein:
Signal peptide:
amino acids 1-15

Transmembrane domain:
amino acids 291-310

N-glycosylation site.
amino acids 213-216

Eukaryotic-type carbonic anhydrases proteins
amino acids 197-245, 104-140, 22-69

FIGURE 269

GTGGCGCTGGCGGTTGCTGTCAGCTGATTCCCGGGGTTGGTGGCAGCGGCGGTAGCAGCAATGGACTTTCTCCTG
GGGAACCCGTTCAGCTCTCCAGTGGGACAGCGCATCGAGAAAGCCACAGATGGCTCCCTGCAGAGCGAGGACTGG
GCCCTCAACATGGAGATCTGCGACATCATCAACGAGACGGAGGAAGGTCCCAAAGATGCCCTCCGAGCAGTAAAG
AAGAGAATCGTGGGGAATAAGAACTTCCACGAGGTGATGCTGGCTCTCACAGTCTTAGAAACCTGTGTCAAGAAC
TGCGGGCACCGCTTCCACGTGCTGGTGGCCAGCCAGGACTTCGTGGAGAGTGTGCTGGTGAGGACCATCCTGCCC
AAGAACAACCCACCCACCATCGTGCATGACAAAGTGCTCAACCTCATCCAGTCCTGGGCTGACGCGTTCCGCAGC
TCGCCCGATCTGACAGGTGTGGTCACCATCTATGAGGACCTGCGGAGGAAAGGCCTGGAGTTCCCCATGACTGAC
CTGGACATGCTGTCACCCATCCACACACCCAGAGGACCGTGTTCAACTCAGAGACACAATCAGGACAGGATTCTG
TGGGCACTGACTCCAGCCAGCAAGAGGACTCTGGCCAGCATGCTGCCCCTCTGCCCGCCCCGCCCATACTCTCCG
GTGACACGCCCATAGCACCAACCCCGGAACAGATTGGGAAGCTGCGCAGTGAGCTGGAGATGGTGAGTGGGAACG
TGAGGGTGATGTCGGAGATGCTGACGGAGCTGGTGCCCACCCAGGCCGAGCCCGCAGACCTGGAGCTGCTGCAGG
AGCTCAACCGCACGTGCCGAGCCATGCAGCAGCGGGTCCTGAGTGATACCCTGCTCCGGGCCCATGCCCCAAGGA
GCCCTTCAGAGCCCACACTGCCAGTCGAGGCCTGGCTGGAGGCTGGCCACAGTGGAAATTCTGCCGAGCCTATTG
TCCCTACCCTGCTCTGCTGCATGGGGCCCCATGGCTTTGGCTGGCCACTGAGGGTAGGGTGTGGAGGTGTGGAGG
CCCCCTGAGGAGCTGCGGCGGCCCAGGTACGAAGCTGCAACTCTGCGCGCAGTGGGCGAGATCTCATCAGCCCCA
GGCTGCAGGTGAGGCTTCAGGGGATGCTGGGGCCCCACTGCCCCTCCGCTGCCTTGCCCTCCATCCTTCCTCTGT
TCCTTCTGGCCGGGCACCACAGCACTGGGGCTCACCTCTTGGTTGATCCTCTTGTACTGGGAGAGGTGCCTTTTG
TATCCCCAATTAAAGGTAGAAAACC

FIGURE 270

></usr/seqdb2/sst/DNA/Dnaseqs.min/ss.DNA62813
><subunit 1 of 1, 209 aa, 1 stop
><MW: 23465, pI: 7.57, NX(S/T): 1
MDFLLGNPFSSPVGQRIEKATDGSLQSEDWALNMEICDIINETEEGPKDALRAVKKRIVGNKNFHEVMLALTVLE
TCVKNCGHRFHVLVASQDFVESVLVRTILPKNNPPTIVHDKVLNLIQSWADAFRSSPDLTGVVTIYEDLRRKGLE
FPMTDLDMLSPIHTPRGPCSTQRHNQDRILWALTPASKRTLASMLPLCPPRPYSPVTRP

Important features of the protein:
Signal peptide:
Amino acids 1-15

N-glycosylation site:
Amino acids 41-45

N-myristoylation sites:
Amino acids 6-12;23-29

FIGURE 271

CGGACGCGTGGGCGGACGCGTGGGCGGACGCGTGGGTCTCTGCGGGGAGACGCCAGCCTGCGTCTGCCATGGGGC
TCGGGTTGAGGGGCTGGGGACGTCCTCTGCTGACTGTGGCCACCGCCCTGATGCTGCCCGTGAAGCCCCCCGCAG
GCTCCTGGGGGGCCCAGATCATCGGGGGCCACGAGGTGACCCCCCACTCCAGGCCCTACATGGCATCCGTGCGCT
TCGGGGGCCAACATCACTGCGGAGGCTTCCTGCTGCGAGCCCGCTGGGTGGTCTCGGCCGCCCACTGCTTCAGCC
ACAGAGACCTCCGCACTGGCCTGGTGGTGCTGGGCGCCCACGTCCTGAGTACTGCGGAGCCCACCCAGCAGGTGT
TTGGCATCGATGCTCTCACCACGCACCCCGACTACCACCCCATGACCCACGCCAACGACATCTGCCTGCTGCGGC
TGAACGGCTCTGCTGTCCTGGGCCCTGCAGTGGGGCTGCTGAGGCTGCCAGGGAGAAGGGCCAGGCCCCCCACAG
CGGGGACACGGTGCCGGGTGGCTGGCTGGGGCTTCGTGTCTGACTTTGAGGAGCTGCCGCCTGGACTGATGGAGG
CCAAGGTCCGAGTGCTGGACCCGGACGTCTGCAACAGCTCCTGGAAGGGCCACCTGACACTTACCATGCTCTGCA
CCCGCAGTGGGGACAGCCACAGACGGGGCTTCTGCTCGGCCGACTCCGGAGGGCCCCTGGTGTGCAGGAACCGGG
CTCACGGCCTCGTTTCCTTCTCGGGCCTCTGGTGCGGCGACCCCAAGACCCCCGACGTGTACACGCAGGTGTCCG
CCTTTGTGGCCTGGATCTGGGACGTGGTTCGGCGGAGCAGTCCCCAGCCCGGCCCCCTGCCTGGGACCACCAGGC
CCCCAGGAGAAGCCGCCTGAGCCACAACCTTGCGGCATGCAAATGAGATGGCCGCTCCAGGCCTGGAATGTTCCG
TGGCTGGGCCCCACGGGAAGCCTGATGTTCAGGGTTGGGGTGGGACGGGCAGCGGTGGGGCACACCCATTCCACA
TGCAAAGGGCAGAAGCAAACCCAGTAAAATGTTAACTGACAAAAAAAAAAAAAAAAAAAAAGAAA

FIGURE 272

></usr/seqdb2/sst/DNA/Dnaseqs.min/ss.DNA62845
><subunit 1 of 1, 283 aa, 1 stop
><MW: 30350, pI: 9.66, NX(S/T): 2
MGLGLRGWGRPLLTVATALMLPVKPPAGSWGAQIIGGHEVTPHSRPYMASVRFGGQHHCGGFLLRARWVVSAAHC
FSHRDLRTGLVVLGAHVLSTAEPTQQVFGIDALTTHPDYHPMTHANDICLLRLNGSAVLGPAVGLLRLPGRRARP
PTAGTRCRVAGWGFVSDFEELPPGLMEAKVRVLDPDVCNSSWKGHLTLTMLCTRSGDSHRRGFCSADSGGPLVCR
NRAHGLVSFSGLWCGDPKTPDVYTQVSAFVAWIWDVVRRSSPQPGPLPGTTRPPGEAA

Signal peptide:
amino acids 1-30

FIGURE 273

GAAGTTCGCGAGCGCTGGCTATGGGTCCTGGGGCGCGGCTGGCGGCGCTGCTGGCGGTGCTGGCGCTCGGGACAG
GAGACCCAGAAAGGGCTGCGGCTCGGGGCGACACGTTCTCGGCGCTGACCAGCGTGGCGCGCGCCCTGGCGCCCG
AGCGCCGGCTGCTGGGGCTGCTGAGGCGGTACCTGCGCGGGGAGGAGGCGCGGCTGCGGGACCTGACTAGATTCT
ACGACAAGGTACTTTCTTTGCATGAGGATTCAACAACCCCTGTGGCTAACCCTCTGCTTGCATTTACTCTCATCA
AACGCCTGCAGTCTGACTGGAGGAATGTGGTACATAGTCTGGAGGCCAGTGAGAACATCCGAGCTCTGAAGGATG
GCTATGAGAAGGTGGAGCAAGACCTTCCAGCCTTTGAGGACCTTGAGGGAGCAGCAAGGGCCCTGATGCGGCTGC
AGGACGTGTACATGCTCAATGTGAAAGGCCTGGCCCGAGGTGTCTTTCAGAGAGTCACTGGCTCTGCCATCACTG
ACCTGTACAGCCCCAAACGGCTCTTTTCTCTCACAGGGGATGACTGCTTCCAAGTTGGCAAGGTGGCCTATGACA
TGGGGGATTATTACCATGCCATTCCATGGCTGGAGGAGGCTGTCAGTCTCTTCCGAGGATCTTACGGAGAGTGGA
AGACAGAGGATGAGGCAAGTCTAGAAGATGCCTTGGATCACTTGGCCTTTGCTTATTTCCGGGCAGGAAATGTTT
CGTGTGCCCTCAGCCTCTCTCGGGAGTTTCTTCTCTACAGCCCAGATAATAAGAGGATGGCCAGGAATGTCTTGA
AATATGAAAGGCTCTTGGCAGAGAGCCCCAACCACGTGGTAGCTGAGGCTGTCATCCAGAGGCCCAATATACCCC
ACCTGCAGACCAGAGACACCTACGAGGGGCTATGTCAGACCCTGGGTTCCCAGCCCACTCTCTACCAGATCCCTA
GCCTCTACTGTTCCTATGAGACCAATTCCAACGCCTACCTGCTGCTCCAGCCCATCCGGAAGGAGGTCATCCACC
TGGAGCCCTACATTGCTCTCTACCATGACTTCGTCAGTGACTCAGAGGCTCAGAAAATTAGAGAACTTGCAGAAC
CATGGCTACAGAGGTCAGTGGTGGCATCAGGGGAGAAGCAGTTACAAGTGGAGTACCGCATCAGCAAAAGTGCCT
GGCTGAAGGACACTGTTGACCCAAAACTGGTGACCCTCAACCACCGCATTGCTGCCCTCACAGGCCTTGATGTCC
GGCCTCCCTATGCAGAGTATCTGCAGGTGGTGAACTATGGCATCGGAGGACACTATGAGCCTCACTTTGACCATG
CTACGTCACCAAGCAGCCCCCTCTACAGAATGAAGTCAGGAAACCGAGTTGCAACATTTATGATCTATCTGAGCT
CGGTGGAAGCTGGAGGAGCCACAGCCTTCATCTATGCCAACCTCAGCGTGCCTGTGGTTAGGAATGCAGCACTGT
TTTGGTGGAACCTGCACAGGAGTGGTGAAGGGGACAGTGACACACTTCATGCTGGCTGTCCTGTCCTGGTGGGAG
ATAAGTGGGTGGCCAACAAGTGGATACATGAGTATGGACAGGAATTCCGCAGACCCTGCAGCTCCAGCCCTGAAG
ACTGAACTGTTGGCAGAGAGAAGCTGGTGGAGTCCTGTGGCTTTCCAGAGAAGCCAGGAGCCAAAAGCTGGGGTA
GGAGAGGAGAAAGCAGAGCAGCCTCCTGGAAGAAGGCCTTGTCAGCTTTGTCTGTGCCTCGCAAATCAGAGGCAA
GGGAGAGGTTGTTACCAGGGGACACTGAGAATGTACATTTGATCTGCCCCAGCCACGGAAGTCAGAGTAGGATGC
ACAGTACAAAGGAGGGGGGAGTGGAGGCCTGAGAGGGAAGTTTCTGGAGTTCAGATACTCTCTGTTGGGAACAGG
ACATCTCAACAGTCTCAGGTTCGATCAGTGGGTCTTTTGGCACTTTGAACCTTGACCACAGGGACCAAGAAGTGG
CAATGAGGACACCTGCAGGAGGGGCTAGCCTGACTCCCAGAACTTTAAGACTTTCTCCCCACTGCCTTCTGCTGC
AGCCCAAGCAGGGAGTGTCCCCCTCCCAGAAGCATATCCCAGATGAGTGGTACATTATATAAGGATTTTTTTTAA
GTTGAAAACAACTTTCTTTTCTTTTTGTATGATGGTTTTTTAACACAGTCATTAAAAATGTTTATAAATCAAAA

FIGURE 274

></usr/seqdb2/sst/DNA/Dnaseqs.min/ss.DNA64849
><subunit 1 of 1, 544 aa, 1 stop
><MW: 61126, pI: 6.40, NX(S/T): 2
MGPGARLAALLAVLALGTGDPERAAARGDTFSALTSVARALAPERRLLGLLRRYLRGEEA
RLRDLTRFYDKVLSLHEDSTTPVANPLLAFTLIKRLQSDWRNVVHSLEASENIRALKDGY
EKVEQDLPAFEDLEGAARALMRLQDVYMLNVKGLARGVFQRVTGSAITDLYSPKRLFSLT
GDDCFQVGKVAYDMGDYYHAIPWLEEAVSLFRGSYGEWKTEDEASLEDALDHLAFAYFRA
GNVSCALSLSREFLLYSPDNKRMARNVLKYERLLAESPNHVVAEAVIQRPNIPHLQTRDT
YEGLCQTLGSQPTLYQIPSLYCSYETNSNAYLLLQPIRKEVIHLEPYIALYHDFVSDSEA
QKIRELAEPWLQRSVVASGEKQLQVEYRISKSAWLKDTVDPKLVTLNHRIAALTGLDVRP
PYAEYLQVVNYGIGGHYEPHFDHATSPSSPLYRMKSGNRVATFMIYLSSVEAGGATAFIY
ANLSVPVVRNAALFWWNLHRSGEGDSDTLHAGCPVLVGDKWVANKWIHEYGQEFRRPCSS
SPED

Important features of the protein:
Signal peptide:
Amino acids 1-19

Leucine zipper pattern:
Amino acids 34-56;41-63

Ribonucleotide reductase small subunit signature:
Amino acids 340-356

N-glycosylation sites:
Amino acids 242-246;482-486

Cell attachment sequence:
Amino acids 27-30

Tyrosine kinase phosphorylation site:
Amino acids 189-198

N-myristoylation sites:
Amino acids 4-10;135-141;153-159;164-170;241-247;303-309;309-315;
457-463;473-479

FIGURE 275

GGCAACATGGCTCAGCAGGCTTGCCCCAGAGCCATGGCAAAGAATGGACTTGTAATTTGCATCCTGGTGATCACC
TTACTCCTGGACCAGACCACCAGCCACACATCCAGATTAAAAGCCAGGAAGCACAGCAAACGTCGAGTGAGAGAC
AAGGATGGAGATCTGAAGACTCAAATTGAAAAGCTCTGGACAGAAGTCAATGCCTTGAAGGAAATTCAAGCCCTG
CAGACAGTCTGTCTCCGAGGCACTAAAGTTCACAAGAAATGCTACCTTGCTTCAGAAGGTTTGAAGCATTTCCAT
GAGGCCAATGAAGACTGCATTTCCAAAGGAGGAATCCTGGTTATCCCCAGGAACTCCGACGAAATCAACGCCCTC
CAAGACTATGGTAAAAGGAGCCTGCCAGGTGTCAATGACTTTTGGCTGGGCATCAATGACATGGTCACGGAAGGC
AAGTTTGTTGACGTCAACGGAATCGCTATCTCCTTCCTCAACTGGGACCGTGCACAGCCTAACGGTGGCAAGCGA
GAAAACTGTGTCCTGTTCTCCCAATCAGCTCAGGGCAAGTGGAGTGATGAGGCCTGTCGCAGCAGCAAGAGATAC
ATATGCGAGTTCACCATCCCTAAATAGGTCTTTCTCCAATGTGTCCTCCAAGCAAGATTCATCATAACTTATAGG
TTCATGATCTCTAAGATCAAGTAAAAATCATAATTTTTACTTATTAAAAAATTGCAACACAAGATCAATGTCCAT
AGCAATATGATAGCATCAGCCAATTTTGCTAACACATTTCTTTGGGATTTTGCCCTTCCTGGGGTATAGGGGATC
AGAAATATTGATCCATGTGCACGCAGATAAAATGGCTTCTGCTAAACAGACTAAAATCTTTCTCTCTAGTCTTTC
TCACTTGTACAAACCCAGTTTGTTTTCAAAAAATCACAGTAGCAATGCAACTCATCACTCTAGAAAAGCAAGCTT
AGGCTACCTGAAAGATTTTCCCTTGGAAGTTTAGCGTATGTTTGACTAACAAAAATTCCCTACATCAGAGACTCT
AGGTGCTATATAATCCAAAAACTTTTCAGCCTGTTGCTCATTCTGTCCCATGCTGGCAATAATACCTTGTCAGCC
CATTACCCTTATTTTGAATTGCTCCATCTCCTGGTGGGACTTGTATCTTGTCTGCCATATCAGAACACAAACCCC
TGAAGAGGTTCTGATTTGATTTTTTTTTTTTCTTCATGCCTACCCTTTTTTTGGAAGTTTCCAGCCGCAATTTGA
AATGAAATGACAAGGTGTATATTTGATCAATTTTCATTCCCACCATTGCATTACAACCTCTAACTTAAATGGGTA
ACCCTAAGGCATATCAAAGAAGCAGATTGCATGATAAACGGAAATAGAAAAAAAGAACCTACATTTATTTTGCTT
TAGCATCCTTACTCTCACCTTTTATGAGATTGAGAGTGGACTTACATTTCCTTTTTTACATTTTCGTATATTTAT
TTTTTTTAGCCATCATTATATGTTTAAGTCTATTATGGGCAACCAATCTTTGGAAGCTGAAAACTGAATTTAAAG
AATGCTATCTTGGAAAATTGCATACGTCTGTGCAATTTTTTATTCTGCCTAGTGCTATTCTGCTTGTTTAACTAG
ATTGTACAAAATAACTTCATTGCTTAATATCAAATTACAAAGTTTAGACTTGGAGGGAAATGGGCTTTTTAGAAG
CAAACAATTTTAAATATATTTTGTTCTTCAAATAAATAGTGTTTAAACATTGAATGTGTTTTGTGAACAATATCC
CACTTTGCAAACTTTAACTACACATGCTTGGAATTAAGTTTTAGCTGTTTTCATTGCTCAATAATAAAGCCTGAA
TTCTGATCAATAAAAAAAAAAAAAAAAAAAAAAAAAAAAAA

FIGURE 276

MAQQACPRAMAKNGLVICILVITLLLDQTTSHTSRLKARKHSKRRVRDKDGDLKTQIEKLWTEVNALKEIQALQT
VCLRGTKVHKKCYLASEGLKHFHEANEDCISKGGILVIPRNSDEINALQDYGKRSLPGVNDFWLGINDMVTEGKF
VDVNGIAISFLNWDRAQPNGGKRENCVLFSQSAQGKWSDEACRSSKRYICEFTIPK

FIGURE 277

GAGATAGGGAGTCTGGGTTTAAGTTCCTGCTCCATCTCAGGAGCCCCTGCTCCCACCCCTAGGAAGCCACCAGAC
TCCACGGTGTGGGGCCAATCAGGTGGAATCGGCCCTGGCAGGTGGGGCCACGAGCGCTGGCTGAGGGACCGAGCC
GGAGAGCCCCGGAGCCCCCGTAACCCGCGCGGGGAGCGCCCAGGATGCCGCGCGGGGACTCGGAGCAGGTGCGCT
ACTGCGCGCGCTTCTCCTACCTCTGGCTCAAGTTTTCACTTATCATCTATTCCACCGTGTTCTGGCTGATTGGGG
CCCTGGTCCTGTCTGTGGGCATCTATGCAGAGGTTGAGCGGCAGAAATATAAAACCCTTGAAAGTGCCTTCCTGG
CTCCAGCCATCATCCTCATCCTCCTGGGCGTCGTCATGTTCATGGTCTCCTTCATTGGTGTGCTGGCGTCCCTCC
GTGACAACCTGTACCTTCTCCAAGCATTCATGTACATCCTTGGGATCTGCCTCATCATGGAGCTCATTGGTGGCG
TGGTGGCCTTGACCTTCCGGAACCAGACCATTGACTTCCTGAACGACAACATTCGAAGAGGAATTGAGAACTACT
ATGATGATCTGGACTTCAAAAACATCATGGACTTTGTTCAGAAAAAGTTCAAGTGCTGTGGCGGGGAGGACTACC
GAGATTGGAGCAAGAATCAGTACCACGACTGCAGTGCCCCTGGACCCCTGGCCTGTGGGGTGCCCTACACCTGCT
GCATCAGGAACACGACAGAAGTTGTCAACACCATGTGTGGCTACAAAACTATCGACAAGGAGCGTTTCAGTGTGC
AGGATGTCATCTACGTGCGGGGCTGCACCAACGCCGTGATCATCTGGTTCATGGACAACTACACCATCATGGCGT
GCATCCTCCTGGGCATCCTGCTTCCCCAGTTCCTGGGGGTGCTGCTGACGCTGCTGTACATCACCCGGGTGGAGG
ACATCATCATGGAGCACTCTGTCACTGATGGGCTCCTGGGGCCCGGTGCCAAGCCCAGCGTGGAGGCGGCAGGCA
CGGGATGCTGCTTGTGCTACCCCAATTAGGGCCCAGCCTGCCATGGCAGCTCCAACAAGGACCGTCTGGGATAGC
ACCTCTCAGTCAACATCGTGGGGCTGGACAGGGCTGCGGCCCCTCTGCCCACACTCAGTACTGACCAAAGCCAGG
GCTGTGTGTGCCTGTGTGTAGGTCCCACGGCCTCTGCCTCCCCAGGGAGCAGAGCCTGGGCCTCCCCTAAGAGGC
TTTCCCCGAGGCAGCTCTGGAATCTGTGCCCACCTGGGGCCTGGGGAACAAGGCCCTCCTTTCTCCAGGCCTGGG
CTACAGGGGAGGGAGAGCCTGAGGCTCTGCTCAGGGCCCATTTCATCTCTGGCAGTGCCTTGGCGGTGGTATTCA
AGGCAGTTTTGTAGCACCTGTAATTGGGGAGAGGGAGTGTGCCCCTCGGGGCAGGAGGGAAGGGCATCTGGGGAA
GGGCAGGAGGGAAGAGCTGTCCATGCAGCCACGCCCATGGCCAGGTTGGCCTCTTCTCAGCCTCCCAGGTGCCTT
GAGCCCTCTTGCAAGGGCGGCTGCTTCCTTGAGCCTAGTTTTTTTTTACGTGATTTTTGTAACATTCATTTTTTT
GTACAGATAACAGGAGTTTCTGACTAATCAAAGCTGGTATTTCCCCGCATGTCTTATTCTTGCCCTTCCCCCAAC
CAGTTTGTTAATCAAACAATAAAAACATGTTTTGTTTTGTTTTTAAAAAAAAA

FIGURE 278

></usr/seqdb2/sst/DNA/Dnaseqs.min/ss.DNA64863
><subunit 1 of 1, 294 aa, 1 stop
><MW: 33211, pI: 5.35, NX(S/T): 3
MPRGDSEQVRYCARFSYLWLKFSLIIYSTVFWLIGALVLSVGIYAEVERQKYKTLESAFLAPAIILILLGVVMFM
VSFIGVLASLRDNLYLLQAFMYILGICLIMELIGGVVALTFRNQTIDFLNDNIRRGIENYYDDLDFKNIMDFVQK
KFKCCGGEDYRDWSKNQYHDCSAPGPLACGVPYTCCIRNTTEVVNTMCGYKTIDKERFSVQDVIYVRGCTNAVII
WFMDNYTIMACILLGILLPQFLGVLLTLLYITRVEDIIMEHSVTDGLLGPGAKPSVEAAGTGCCLCYPN

Signal peptide:
amino acids 1-44

Transmembrane domains:
amino acids 22-42, 57-85, 93-116, 230-257

FIGURE 279

GAGGAGCGGGCCGAGGACTCCAGCGTGCCCAGGTCTGGCATCCTGCACTTGCTGCCCTCTGACACCTGGGAAGAT
GGCCGGCCCGTGGACCTTCACCCTTCTCTGTGGTTTGCTGGCAGCCACCTTGATCCAAGCCACCCTCAGTCCCAC
TGCAGTTCTCATCCTCGGCCCAAAAGTCATCAAAGAAAAGCTGACACAGGAGCTGAAGGACCACAACGCCACCAG
CATCCTGCAGCAGCTGCCGCTGCTCAGTGCCATGCGGGAAAAGCCAGCCGGAGGCATCCCTGTGCTGGGCAGCCT
GGTGAACACCGTCCTGAAGCACATCATCTGGCTGAAGGTCATCACAGCTAACATCCTCCAGCTGCAGGTGAAGCC
CTCGGCCAATGACCAGGAGCTGCTAGTCAAGATCCCCCTGGACATGGTGGCTGGATTCAACACGCCCCTGGTCAA
GACCATCGTGGAGTTCCACATGACGACTGAGGCCCAAGCCACCATCCGCATGGACACCAGTGCAAGTGGCCCCAC
CCGCCTGGTCCTCAGTGACTGTGCCACCAGCCATGGGAGCCTGCGCATCCAACTGCTGTATAAGCTCTCCTTCCT
GGTGAACGCCTTAGCTAAGCAGGTCATGAACCTCCTAGTGCCATCCCTGCCCAATCTAGTGAAAAACCAGCTGTG
TCCCGTGATCGAGGCTTCCTTCAATGGCATGTATGCAGACCTCCTGCAGCTGGTGAAGGTGCCCATTTCCCTCAG
CATTGACCGTCTGGAGTTTGACCTTCTGTATCCTGCCATCAAGGGTGACACCATTCAGCTCTACCTGGGGGCCAA
GTTGTTGGACTCACAGGGAAAGGTGACCAAGTGGTTCAATAACTCTGCAGCTTCCCTGACAATGCCCACCCTGGA
CAACATCCCGTTCAGCCTCATCGTGAGTCAGGACGTGGTGAAAGCTGCAGTGGCTGCTGTGCTCTCTCCAGAAGA
ATTCATGGTCCTGTTGGACTCTGTGCTTCCTGAGAGTGCCCATCGGCTGAAGTCAAGCATCGGGCTGATCAATGA
AAAGGCTGCAGATAAGCTGGGATCTACCCAGATCGTGAAGATCCTAACTCAGGACACTCCCGAGTTTTTTATAGA
CCAAGGCCATGCCAAGGTGGCCCAACTGATCGTGCTGGAAGTGTTTCCCTCCAGTGAAGCCCTCCGCCCTTTGTT
CACCCTGGGCATCGAAGCCAGCTCGGAAGCTCAGTTTTACACCAAAGGTGACCAACTTATACTCAACTTGAATAA
CATCAGCTCTGATCGGATCCAGCTGATGAACTCTGGGATTGGCTGGTTCCAACCTGATGTTCTGAAAAACATCAT
CACTGAGATCATCCACTCCATCCTGCTGCCGAACCAGAATGGCAAATTAAGATCTGGGGTCCCAGTGTCATTGGT
GAAGGCCTTGGGATTCGAGGCAGCTGAGTCCTCACTGACCAAGGATGCCCTTGTGCTTACTCCAGCCTCCTTGTG
GAAACCCAGCTCTCCTGTCTCCCAGTGAAGACTTGGATGGCAGCCATCAGGGAAGGCTGGGTCCCAGCTGGGAGT
ATGGGTGTGAGCTCTATAGACCATCCCTCTCTGCAATCAATAAACACTTGCCTGTGAAAAA

FIGURE 280

></usr/seqdb2/sst/DNA/Dnaseqs.min/ss.DNA64881
><subunit 1 of 1, 484 aa, 1 stop
><MW: 52468, pI: 7.14, NX(S/T): 3
MAGPWTFTLLCGLLAATLIQATLSPTAVLILGPKVIKEKLTQELKDHNATSILQQLPLLSAMREKPAGGIPVLGS
LVNTVLKHIIWLKVITANILQLQVKPSANDQELLVKIPLDMVAGFNTPLVKTIVEFHMTTEAQATIRMDTSASGP
TRLVLSDCATSHGSLRIQLLYKLSFLVNALAKQVMNLLVPSLPNLVKNQLCPVIEASFNGMYADLLQLVKVPISL
SIDRLEFDLLYPAIKGDTIQLYLGAKLLDSQGKVTKWFNNSAASLTMPTLDNIPFSLIVSQDVVKAAVAAVLSPE
EFMVLLDSVLPESAHRLKSSIGLINEKAADKLGSTQIVKILTQDTPEFFIDQGHAKVAQLIVLEVFPSSEALRPL
FTLGIEASSEAQFYTKGDQLILNLNNISSDRIQLMNSGIGWFQPDVLKNIITEIIHSILLPNQNGKLRSGVPVSL
VKALGFEAAESSLTKDALVLTPASLWKPSSPVSQ

Important features of the protein:
Signal peptide:
amino acids 1-21

N-glycosylation sites.
amino acids 48-51, 264-267, 401-404

Glycosaminoglycan attachment site.
amino acids 412-415

LBP / BPI / CETP family proteins.
amino acids 407-457

FIGURE 281

CCCACGCGTCCGCGCCTCTCCCTTCTGCTGGACCTTCCTTCGTCTCTCCATCTCTCCCTCCTTTCCCCGCGTTCT
CTTTCCACCTTTCTCTTCTTCCCACCTTAGACCTCCCTTCCTGCCCTCCTTTCCTGCCCACCGCTGCTTCCTGGC
CCTTCTCCGACCCCGCTCTAGCAGCAGACCTCCTGGGGTCTGTGGGTTGATCTGTGGCCCCTGTGCCTCCGTGTC
CTTTTCGTCTCCCTTCCTCCCGACTCCGCTCCCGGACCAGCGGCCTGACCCTGGGGAAAGGATGGTTCCCGAGGT
GAGGGTCCTCTCCTCCTTGCTGGGACTCGCGCTGCTCTGGTTCCCCCTGGACTCCCACGCTCGAGCCCGCCCAGA
CATGTTCTGCCTTTTCCATGGGAAGAGATACTCCCCCGGCGAGAGCTGGCACCCCTACTTGGAGCCACAAGGCCT
GATGTACTGCCTGCGCTGTACCTGCTCAGAGGGCGCCCATGTGAGTTGTTACCGCCTCCACTGTCCGCCTGTCCA
CTGCCCCCAGCCTGTGACGGAGCCACAGCAATGCTGTCCCAAGTGTGTGGAACCTCACACTCCCTCTGGACTCCG
GGCCCCACCAAAGTCCTGCCAGCACAACGGGACCATGTACCAACACGGAGAGATCTTCAGTGCCCATGAGCTGTT
CCCCTCCCGCCTGCCCAACCAGTGTGTCCTCTGCAGCTGCACAGAGGGCCAGATCTACTGCGGCCTCACAACCTG
CCCCGAACCAGGCTGCCCAGCACCCCTCCCACTGCCAGACTCCTGCTGCCAAGCCTGCAAAGATGAGGCAAGTGA
GCAATCGGATGAAGAGGACAGTGTGCAGTCGCTCCATGGGGTGAGACATCCTCAGGATCCATGTTCCAGTGATGC
TGGGAGAAAGAGAGGCCCGGGCACCCCAGCCCCCACTGGCCTCAGCGCCCCTCTGAGCTTCATCCCTCGCCACTT
CAGACCCAAGGGAGCAGGCAGCACAACTGTCAAGATCGTCCTGAAGGAGAAACATAAGAAAGCCTGTGTGCATGG
CGGGAAGACGTACTCCCACGGGGAGGTGTGGCACCCGGCCTTCCGTGCCTTCGGCCCCTTGCCCTGCATCCTATG
CACCTGTGAGGATGGCCGCCAGGACTGCCAGCGTGTGACCTGTCCCACCGAGTACCCCTGCCGTCACCCCGAGAA
AGTGGCTGGGAAGTGCTGCAAGATTTGCCCAGAGGACAAAGCAGACCCTGGCCACAGTGAGATCAGTTCTACCAG
GTGTCCCAAGGCACCGGGCCGGGTCCTCGTCCACACATCGGTATCCCCAAGCCCAGACAACCTGCGTCGCTTTGC
CCTGGAACACGAGGCCTCGGACTTGGTGGAGATCTACCTCTGGAAGCTGGTAAAAGATGAGGAAACTGAGGCTCA
GAGAGGTGAAGTACCTGGCCCAAGGCCACACAGCCAGAATCTTCCACTTGACTCAGATCAAGAAAGTCAGGAAGC
AAGACTTCCAGAAAGAGGCACAGCACTTCCGACTGCTCGCTGGCCCCCACGAAGGTCACTGGAACGTCTTCCTAG
CCCAGACCCTGGAGCTGAAGGTCACGGCCAGTCCAGACAAAGTGACCAAGACATAACAAAGACCTAACAGTTGCA
GATATGAGCTGTATAATTGTTGTTATTATATATTAATAAATAAGAAGTTGCATTACCCTCAAAAAAAAAAAAAAA
AAAAAAA

FIGURE 282

></usr/seqdb2/sst/DNA/Dnaseqs.min/ss.DNA64902
><subunit 1 of 1, 451 aa, 1 stop
><MW: 49675, pI: 7.15, NX(S/T): 1
MVPEVRVLSSLLGLALLWFPLDSHARARPDMFCLFHGKRYSPGESWHPYLEPQGLMYCLRCTCSEGAHVSCYRLH
CPPVHCPQPVTEPQQCCPKCVEPHTPSGLRAPPKSCQHNGTMYQHGEIFSAHELFPSRLPNQCVLCSCTEGQIYC
GLTTCPEPGCPAPLPLPDSCCQACKDEASEQSDEEDSVQSLHGVRHPQDPCSSDAGRKRGPGTPAPTGLSAPLSF
IPRHFRPKGAGSTTVKIVLKEKHKKACVHGGKTYSHGEVWHPAFRAFGPLPCILCTCEDGRQDCQRVTCPTEYPC
RHPEKVAGKCCKICPEDKADPGHSEISSTRCPKAPGRVLVHTSVSPSPDNLRRFALEHEASDLVEIYLWKLVKDE
ETEAQRGEVPGPRPHSQNLPLDSDQESQEARLPERGTALPTARWPPRRSLERLPSPDPGAEGHGQSRQSDQDITKT

Signal peptide:
amino acids 1-25

FIGURE 283

GCGATGGTGCGCCCGGTGGCGGTGGCGGCGGCGGTTGCGGAGGCTTCCTTGGTCGGATTGCAACGAGGAGAAGAT
GACTGACCAACCGACTGGCTGAATGAATGAATGGCGGAGCCGAGCGCGCCATGAGGAGCCTGCCGAGCCTGGGCG
GCCTCGCCCTGTTGTGCTGCGCCGCCGCCGCCGCCGCCGTCGCCTCAGCCGCCTCGGCGGGGAATGTCACCGGTG
GCGGCGGGGCCGCGGGGCAGGTGGACGCGTCGCCGGGCCCCGGGTTGCGGGGCGAGCCCAGCCACCCCTTCCCTA
GGGCGACGGCTCCCACGGCCCAGGCCCCGAGGACCGGGCCCCCGCGCGCCACCGTCCACCGACCCCTGGCTGCGA
CTTCTCCAGCCCAGTCCCCGGAGACCACCCCTCTTTGGGCGACTGCTGGACCCTCTTCCACCACCTTTCAGGCGC
CGCTCGGCCCCTCGCCGACCACCCCTCCGGCGGCGGAACGCACTTCGACCACCTCTCAGGCGCCGACCAGACCCG
CGCCGACCACCCTTTCGACGACCACTGGCCCGGCGCCGACCACCCCTGTAGCGACCACCGTACCGGCGCCCACGA
CTCCCCGGACCCCGACCCCCGATCTCCCCAGCAGCAGCAACAGCAGCGTCCTCCCCACCCCACCTGCCACCGAGG
CCCCCTCTTCGCCTCCTCCAGAGTATGTATGTAACTGCTCTGTGGTTGGAAGCCTGAATGTGAATCGCTGCAACC
AGACCACAGGGCAGTGTGAGTGTCGGCCAGGTTATCAGGGGCTTCACTGTGAAACCTGCAAAGAGGGCTTTTACC
TAAATTACACTTCTGGGCTCTGTCAGCCATGTGACTGTAGTCCACATGGAGCTCTCAGCATACCGTGCAACAGGT
AAGCAACAGAGGGTGGAACTGAAGTTTATTTTATTTTAGCAAGGGAAAAAAAAAGGCTGCTACTCTCAAGGACCA
TACTGGTTTAAACAAAGGAGGATGAGGGTCATAGATTTACAAAATATTTTATATACTTTTATTCTCTTACTTTAT
ATGTTATATTTAATGTCAGGATTTAAAAACATCTAATTTACTGATTTAGTTCTTCAAAAGCACTAGAGTCGCCAA
TTTTTCTCTGGGATAATTTCTGTAAATTTCATGGGAAAAAATTATTGAAGAATAAATCTGCTTTCTGGAAGGGCT
TTCAGGCATGAAACCTGCTAGGAGGTTTAGAAATGTTCTTATGTTTATTAATATACCATTGGAGTTTGAGGAAAT
TTGTTGTTTGGTTTATTTTTCTCTCTAATCAAAATTCTACATTTGTTTCTTTGGACATCTAAAGCTTAACCTGGG
GGTACCCTAATTTATTTAACTAGTGGTAAGTAGACTGGTTTTACTCTATTTACCAGTACATTTTTGAGACCAAAA
GTAGATTAAGCAGGAATTATCTTTAAACTATTATGTTATTTGGAGGTAATTTAATCTAGTGGAATAATGTACTGT
TATCTAAGCATTTGCCTTGTACTGCACTGAAAGTAATTATTCTTTGACCTTATGTGAGGCACTTGGCTTTTTGTG
GACCCCAAGTCAAAAAACTGAAGAGACAGTATTAAATAATGAAAAAAATAATGACAGGTTATACTCAGTGTAACC
TGGGTATAACCCAAGATCTGCTGCCACTTACGAGCTGTGTTCCTTGGGCAAGTAATTTCCTTTCACTGAGCTTGT
TTCTTCTCAAGGTTGTTGTGAAGATTAAATGAGTTGATATATATAAAATGCCTAGCACATGTCACTCAATAAATT
CTGGTTTGTTTTAATTTCAAAGGAATATTATGGACTGAAATGAGAGAACATGTTTTAAGAACTTTTAGCTCCTTG
ACAAAGAAGTGCTTTATACTTTAGCACTAAATATTTTAAATGCTTTATAAATGATATTATACTGTTATGGAATAT
TGTATCATATTGTAGTTTATTAAAAATGTAGAAGAGGCTGGGCGCGGTGGCTCACGCCTGTAATCCTAGCACTTT
GGGAGGCCAAGGCGGGTGGATCACTTGAGGCCAGGAGTTCTAGATGAGCCTGGCCAGCACAGTGAAACCCCGTCT
CTACTAAAAATACAAACAAATTAGCTGGGCGTGGTGGCACACACCTGTAGTCCCAGCTACTCGGGAGGCTGAGGC
AGGAGAATCGGTTGAACCCGGGAGGTGGAGGTTGCAGTGAGCTGAGATCGCGCCACTGCACTCCAGCCTGGTGAG
AGAGGGAGACTCTGTCTTAAAAAAAAAAAAAAAAAAAAAAAAAA

FIGURE 284

></usr/seqdb2/sst/DNA/Dnaseqs.min/ss.DNA64952
><subunit 1 of 1, 258 aa, 1 stop
><MW: 25716, pI: 8.13, NX(S/T): 5
MRSLPSLGGLALLCCAAAAAAVASAASAGNVTGGGGAAGQVDASPGPGLRGEPSHPFPRATAPTAQAPRTGPPRA
TVHRPLAATSPAQSPETTPLWATAGPSSTTFQAPLGPSPTTPPAAERTSTTSQAPTRPAPTTLSTTTGPAPTTPV
ATTVPAPTTPRTPTPDLPSSSNSSVLPTPPATEAPSSPPPEYVCNCSVVGSLNVNRCNQTTGQCECRPGYQGLHC
ETCKEGFYLNYTSGLCQPCDCSPHGALSIPCNR

Important features of the protein:
Signal peptide:
amino acids 1-25

N-glycosylation sites.
amino acids 30-33, 172-175, 195-198, 208-211, 235-238

EGF-like domain cysteine pattern signature.
amino acids 214-226.

FIGURE 285

AACAGACGTTCCCTCGCGGCCCTGGCACCTCTAACCCCAGACATGCTGCTGCTGCTGCTGCCCCTGCTCTGGGGG
AGGGAGAGGGCGGAAGGACAGACAAGTAAACTGCTGACGATGCAGAGTTCCGTGACGGTGCAGGAAGGCCTGTGT
GTCCATGTGCCCTGCTCCTTCTCCTACCCCTCGCATGGCTGGATTTACCCTGGCCCAGTAGTTCATGGCTACTGG
TTCCGGGAAGGGGCCAATACAGACCAGGATGCTCCAGTGGCCACAAACAACCCAGCTCGGGCAGTGTGGGAGGAG
ACTCGGGACCGATTCCACCTCCTTGGGGACCCACATACCAAGAATTGCACCCTGAGCATCAGAGATGCCAGAAGA
AGTGATGCGGGGAGATACTTCTTTCGTATGGAGAAAGGAAGTATAAAATGGAATTATAAACATCACCGGCTCTCT
GTGAATGTGACAGCCTTGACCCACAGGCCCAACATCCTCATCCCAGGCACCCTGGAGTCCGGCTGCCCCCAGAAT
CTGACCTGCTCTGTGCCCTGGGCCTGTGAGCAGGGGACACCCCCTATGATCTCCTGGATAGGGACCTCCGTGTCC
CCCCTGGACCCCTCCACCACCCGCTCCTCGGTGCTCACCCTCATCCCACAGCCCCAGGACCATGGCACCAGCCTC
ACCTGTCAGGTGACCTTCCCTGGGGCCAGCGTGACCACGAACAAGACCGTCCATCTCAACGTGTCCTACCCGCCT
CAGAACTTGACCATGACTGTCTTCCAAGGAGACGGCACAGTATCCACAGTCTTGGGAAATGGCTCATCTCTGTCA
CTCCCAGAGGGCCAGTCTCTGCGCCTGGTCTGTGCAGTTGATGCAGTTGACAGCAATCCCCCTGCCAGGCTGAGC
CTGAGCTGGAGAGGCCTGACCCTGTGCCCCTCACAGCCCTCAAACCCGGGGGTGCTGGAGCTGCCTTGGGTGCAC
CTGAGGGATGCAGCTGAATTCACCTGCAGAGCTCAGAACCCTCTCGGCTCTCAGCAGGTCTACCTGAACGTCTCC
CTGCAGAGCAAAGCCACATCAGGAGTGACTCAGGGGGTGGTCGGGGGAGCTGGAGCCACAGCCCTGGTCTTCCTG
TCCTTCTGCGTCATCTTCGTTGTAGTGAGGTCCTGCAGGAAGAAATCGGCAAGGCCAGCAGCGGGCGTGGGAGAT
ACGGGCATAGAGGATGCAAACGCTGTCAGGGGTTCAGCCTCTCAGGGGCCCCTGACTGAACCTTGGGCAGAAGAC
AGTCCCCCAGACCAGCCTCCCCCAGCTTCTGCCCGCTCCTCAGTGGGGGAAGGAGAGCTCCAGTATGCATCCCTC
AGCTTCCAGATGGTGAAGCCTTGGGACTCGCGGGGACAGGAGGCCACTGACACCGAGTACTCGGAGATCAAGATC
CACAGATGAGAAACTGCAGAGACTCACCCTGATTGAGGGATCACAGCCCCTCCAGGCAAGGGAGAAGTCAGAGGC
TGATTCTTGTAGAATTAACAGCCCTCAACGTGATGAGCTATGATAACACTATGAATTATGTGCAGAGTGAAAAGC
ACACAGGCTTTAGAGTCAAAGTATCTCAAACCTGAATCCACACTGTGCCCTCCCTTTTATTTTTTTAACTAAAAG
ACAGACAAATTCCTA

FIGURE 286

MLLLLLPLLWGRERAEGQTSKLLTMQSSVTVQEGLCVHVPCSFSYPSHGWIYPGPVVHGYWFREGANTDQDAPVA
TNNPARAVWEETRDRFHLLGDPHTKNCTLSIRDARRSDAGRYFFRMEKGSIKWNYKHHRLSVNVTALTHRPNILI
PGTLESGCPQNLTCSVPWACEQGTPPMISWIGTSVSPLDPSTTRSSVLTLIPQPQDHGTSLTCQVTFPGASVTTN
KTVHLNVSYPPQNLTMTVFQGDGTVSTVLGNGSSLSLPEGQSLRLVCAVDAVDSNPPARLSLSWRGLTLCPSQPS
NPGVLELPWVHLRDAAEFTCRAQNPLGSQQVYLNVSLQSKATSGVTQGVVGGAGATALVFLSFCVIFVVVRSCRK
KSARPAAGVGDTGIEDANAVRGSASQGPLTEPWAEDSPPDQPPPASARSSVGEGELQYASLSFQMVKPWDSRGQE
ATDTEYSEIKIHR

Signal peptide:
amino acids 1-15

Transmembrane domain:
amino acids 351-370

FIGURE 287

CGCGAGCTGAGAGGAGCAGGTAGAGGGGCAGAGGCGGGACTGTCGTCTGGGGGAGCCGCCCAGGAGGCTCCTCAG
GCCGACCCCAGACCCTGGCTGGCCAGGATGAAGTATCTCCGGCACCGGCGGCCCAATGCCACCCTCATTCTGGCC
ATCGGCGCTTTCACCCTCCTCCTCTTCAGTCTGCTAGTGTCACCACCCACCTGCAAGGTCCAGGAGCAGCCACCG
GCGATCCCCGAGGCCCTGGCCTGGCCCACTCCACCCACCCGCCCAGCCCCGGCCCCGTGCCATGCCAACACCTCT
ATGGTCACCCACCCGGACTTCGCCACGCAGCCGCAGCACGTTCAGAACTTCCTCCTGTACAGACACTGCCGCCAC
TTTCCCCTGCTGCAGGACGTGCCCCCCTCTAAGTGCGCGCAGCCGGTCTTCCTGCTGCTGGTGATCAAGTCCTCC
CCTAGCAACTATGTGCGCCGCGAGCTGCTGCGGCGCACGTGGGGCCGCGAGCGCAAGGTACGGGGTTTGCAGCTG
CGCCTCCTCTTCCTGGTGGGCACAGCCTCCAACCCGCACGAGGCCCGCAAGGTCAACCGGCTGCTGGAGCTGGAG
GCACAGACTCACGGAGACATCCTGCAGTGGGACTTCCACGACTCCTTCTTCAACCTCACGCTCAAGCAGGTCCTG
TTCTTACAGTGGCAGGAGACAAGGTGCGCCAACGCCAGCTTCGTGCTCAACGGGGATGATGACGTCTTTGCACAC
ACAGACAACATGGTCTTCTACCTGCAGGACCATGACCCTGGCCGCCACCTCTTCGTGGGGCAACTGATCCAAAAC
GTGGGCCCCATCCGGGCTTTTTGGAGCAAGTACTATGTGCCAGAGGTGGTGACTCAGAATGAGCGGTACCCACCC
TATTGTGGGGGTGGTGGCTTCTTGCTGTCCCGCTTCACGGCCGCTGCCCTGCGCCGTGCTGCCCATGTCTTGGAC
ATCTTCCCCATTGATGATGTCTTCCTGGGTATGTGTCTGGAGCTTGAGGGACTGAAGCCTGCCTCCCACAGCGGC
ATCCGCACGTCTGGCGTGCGGGCTCCATCGCAACACCTGTCCTCCTTTGACCCCTGCTTCTACCGAGACCTGCTG
CTGGTGCACCGCTTCCTACCTTATGAGATGCTGCTCATGTGGGATGCGCTGAACCAGCCCAACCTCACCTGCGGC
AATCAGACACAGATCTACTGAGTCAGCATCAGGGTCCCCAGCCTCTGGGCTCCTGTTTCCATAGGAAGGGGCGAC
ACCTTCCTCCCAGGAAGCTGAGACCTTTGTGGTCTGAGCATAAGGGAGTGCCAGGGAAGGTTTGAGGTTTGATGA
GTGAATATTCTGGCTGGCGAACTCCTACACATCCTTCAAAACCCACCTGGTACTGTTCCAGCATCTTCCCTGGAT
GGCTGGAGGAACTCCAGAAAATATCCATCTTCTTTTTGTGGCTGCTAATGGCAGAAGTGCCTGTGCTAGAGTTCC
AACTGTGGATGCATCCGTCCCGTTTGAGTCAAAGTCTTACTTCCCTGCTCTCACCTACTCACAGACGGGATGCTA
AGCAGTGCACCTGCAGTGGTTTAATGGCAGATAAGCTCCGTCTGCAGTTCCAGGCCAGCCAGAAACTCCTGTGTC
CACATAGAGCTGACGTGAGAAATATCTTTCAGCCCAGGAGAGAGGGGTCCTGATCTTAACCCTTTCCTGGGTCTC
AGACAACTCAGAAGGTTGGGGGGATACCAGAGAGGTGGTGGAATAGGACCGCCCCCTCCTTACTTGTGGGATCAA
ATGCTGTAATGGTGGAGGTGTGGGCAGAGGAGGGAGGCAAGTGTCTTTGAAAGTTGTGAGAGCTCAGAGTTTCTG
GGGTCCTCATTAGGAGCCCCCATCCCTGTGTTCCCCAAGAATTCAGAGAACAGCACTGGGGCTGGAATGATCTTT
AATGGGCCCAAGGCCAACAGGCATATGCCTCACTACTGCCTGGAGAAGGGAGAGATTCAGGTCCTCCAGCAGCCT
CCCTCACCCAGTATGTTTTACAGATTACGGGGGGACCGGGTGAGCCAGTGACCCCCTGCAGCCCCCAGCTTCAGG
CCTCAGTGTCTGCCAGTCAAGCTTCACAGGCATTGTGATGGGGCAGCCTTGGGGAATATAAAATTTTGTGAAGAA
AAAAAAAAAAAAAAAAAAAAAAAAAAAAAAAAA

FIGURE 288

</usr/seqdb2/sst/DNA/Dnaseqs.min/ss.DNA65413
<subunit 1 of 1, 372 aa, 1 stop
<MW: 42515, pI: 8.92, NX(S/T): 6

MKYLRHRRPNATLILAIGAFTLLLFSLLVSPPTCKVQEQPPAIPEALAWPTPPTRPAPAPCHANTSMVTHPDFAT
QPQHVQNFLLYRHCRHFPLLQDVPPSKCAQPVFLLLVIKSSPSNYVRRELLRRTWGRERKVRGLQLRLLFLVGTA
SNPHEARKVNRLLELEAQTHGDILQWDFHDSFFNLTLKQVLFLQWQETRCANASFVLNGDDDVFAHTDNMVFYLQ
DHDPGRHLFVGQLIQNVGPIRAFWSKYYVPEVVTQNERYPPYCGGGGFLLSRFTAAALRRAAHVLDIFPIDDVFL
GMCLELEGLKPASHSGIRTSGVRAPSQHLSSFDPCFYRDLLLVHRFLPYEMLLMWDALNQPNLTCGNQTQIY

Important features:

Type II transmembrane domain:

Amino acids 15-34

N-glycosylation sites:

Amino acids 10-14;64-68;184-188;202-206;362-366;367-371

TonB-dependent receptor proteins signature 1:

Amino acids 1-32

N-myristoylation sites:

Amino acids 308-314;316-322

FIGURE 289A

CGCGCTCCCCGCGCGCCTCCTCGGGCTCCACGCGTCTTGCCCCGCAGAGGCAGCCTCCTCCAGGAGCGGGGCCCT
GCACACCATGGCCCCCGGGTGGGCAGGGGTCGGCGCCGCCGTGCGCGCCCGCCTGGCGCTGGCCTTGGCGCTGGC
GAGCGTCCTGAGTGGGCCTCCAGCCGTCGCCTGCCCCACCAAGTGTACCTGCTCCGCTGCCAGCGTGGACTGCCA
CGGGCTGGGCCTCCGCGCGGTTCCTCGGGGCATCCCCCGCAACGCTGAGCGCCTTGACCTGGACAGAAATAATAT
CACCAGGATCACCAAGATGGACTTCGCTGGGCTCAAGAACCTCCGAGTCTTGCATCTGGAAGACAACCAGGTCAG
CGTCATCGAGAGAGGCGCCTTCCAGGACCTGAAGCAGCTAGAGCGACTGCGCCTGAACAAGAATAAGCTGCAAGT
CCTTCCAGAATTGCTTTTCCAGAGCACGCCGAAGCTCACCAGACTAGATTTGAGTGAAAACCAGATCCAGGGGAT
CCCGAGGAAGGCGTTCCGCGGCATCACCGATGTGAAGAACCTGCAACTGGACAACAACCACATCAGCTGCATTGA
AGATGGAGCCTTCCGAGCGCTGCGCGATTTGGAGATCCTTACCCTCAACAACAACAACATCAGTCGCATCCTGGT
CACCAGCTTCAACCACATGCCGAAGATCCGAACTCTGCGCCTCCACTCCAACCACCTCTACTGCGACTGCCACCT
GGCCTGGCTCTCGGATTGGCTGCGACAGCGACGGACAGTTGGCCAGTTCACACTCTGCATGGCTCCTGTGCATTT
GAGGGGCTTCAACGTGGCGGATGTGCAGAAGAAGGAGTACGTGTGCCCAGCCCCCCACTCGGAGCCCCCATCCTG
CAATGCCAACTCCATCTCCTGCCCTTCGCCCTGCACGTGCAGCAATAACATCGTGGACTGTCGAGGAAAGGGCTT
GATGGAGATTCCTGCCAACTTGCCGGAGGGCATCGTCGAAATACGCCTAGAACAGAACTCCATCAAAGCCATCCC
TGCAGGAGCCTTCACCCAGTACAAGAAACTGAAGCGAATAGACATCAGCAAGAATCAGATATCGGATATTGCTCC
AGATGCCTTCCAGGGCCTGAAATCACTCACATCGCTGGTCCTGTATGGGAACAAGATCACCGAGATTGCCAAGGG
ACTGTTTGATGGGCTGGTGTCCCTACAGCTGCTCCTCCTCAATGCCAACAAGATCAACTGCCTGCGGGTGAACAC
GTTTCAGGACCTGCAGAACCTCAACTTGCTCTCCCTGTATGACAACAAGCTGCAGACCATCAGCAAGGGGCTCTT
CGCCCCTCTGCAGTCCATCCAGACACTCCACTTAGCCCAAAACCCATTTGTGTGCGACTGCCACTTGAAGTGGCT
GGCCGACTACCTCCAGGACAACCCCATCGAGACAAGCGGGGCCCGCTGCAGCAGCCCGCGCCGACTCGCCAACAA
GCGCATCAGCCAGATCAAGAGCAAGAAGTTCCGCTGCTCAGGCTCCGAGGATTACCGCAGCAGGTTCAGCAGCGA
GTGCTTCATGGACCTCGTGTGCCCCGAGAAGTGTCGCTGTGAGGGCACGATTGTGGACTGCTCCAACCAGAAGCT
GGTCCGCATCCCAAGCCACCTCCCTGAATATGTCACCGACCTGCGACTGAATGACAATGAGGTATCTGTTCTGGA
GGCCACTGGCATCTTCAAGAAGTTGCCCAACCTGCGGAAAATAAATCTGAGTAACAATAAGATCAAGGAGGTGCG
AGAGGGAGCTTTCGATGGAGCAGCCAGCGTGCAGGAGCTGATGCTGACAGGGAACCAGCTGGAGACCGTGCACGG
GCGCGTGTTCCGTGGCCTCAGTGGCCTCAAAACCTTGATGCTGAGGAGTAACTTGATCAGCTGTGTGAGTAATGA
CACCTTTGCCGGCCTGAGTTCGGTGAGACTGCTGTCCCTCTATGACAATCGGATCACCACCATCACCCCTGGGGC
CTTCACCACGCTTGTCTCCCTGTCCACCATAAACCTCCTGTCCAACCCCTTCAACTGCAACTGCCACCTGGCCTG
GCTCGGCAAGTGGTTGAGGAAGAGGCGGATCGTCAGTGGGAACCCTAGGTGCCAGAAGCCATTTTTCCTCAAGGA
GATTCCCATCCAGGATGTGGCCATCCAGGACTTCACCTGTGATGGCAACGAGGAGAGTAGCTGCCAGCTGAGCCC
GCGCTGCCCGGAGCAGTGCACCTGTATGGAGACAGTGGTGCGATGCAGCAACAAGGGGCTCCGCGCCCTCCCCAG
AGGCATGCCCAAGGATGTGACCGAGCTGTACCTGGAAGGAAACCACCTAACAGCCGTGCCCAGAGAGCTGTCCGC
CCTCCGACACCTGACGCTTATTGACCTGAGCAACAACAGCATCAGCATGCTGACCAATTACACCTTCAGTAACAT
GTCTCACCTCTCCACTCTGATCCTGAGCTACAACCGGCTGAGGTGCATCCCCGTCCACGCCTTCAACGGGCTGCG
GTCCCTGCGAGTGCTAACCCTCCATGGCAATGACATTTCCAGCGTTCCTGAAGGCTCCTTCAACGACCTCACATC
TCTTTCCCATCTGGCGCTGGGAACCAACCCACTCCACTGTGACTGCAGTCTTCGGTGGCTGTCGGAGTGGGTGAA
GGCGGGGTACAAGGAGCCTGGCATCGCCCGCTGCAGTAGCCCTGAGCCCATGGCTGACAGGCTCCTGCTCACCAC
CCCAACCCACCGCTTCCAGTGCAAAGGGCCAGTGGACATCAACATTGTGGCCAAATGCAATGCCTGCCTCTCCAG
CCCGTGCAAGAATAACGGGACATGCACCCAGGACCCTGTGGAGCTGTACCGCTGTGCCTGCCCC

FIGURE 289B

TACAGCTACAAGGGCAAGGACTGCACTGTGCCCATCAACACCTGCATCCAGAACCCCTGTCAGCATGGAGGCACC
TGCCACCTGAGTGACAGCCACAAGGATGGGTTCAGCTGCTCCTGCCCTCTGGGCTTTGAGGGGCAGCGGTGTGAG
ATCAACCCAGATGACTGTGAGGACAACGACTGCGAAAACAATGCCACCTGCGTGGACGGGATCAACAACTACGTG
TGTATCTGTCCGCCTAACTACACAGGTGAGCTATGCGACGAGGTGATTGACCACTGTGTGCCTGAGCTGAACCTC
TGTCAGCATGAGGCCAAGTGCATCCCCCTGGACAAAGGATTCAGCTGCGAGTGTGTCCCTGGCTACAGCGGGAAG
CTCTGTGAGACAGACAATGATGACTGTGTGGCCCACAAGTGCCGCCACGGGGCCCAGTGCGTGGACACAATCAAT
GGCTACACATGCACCTGCCCCCAGGGCTTCAGTGGACCCTTCTGTGAACACCCCCCACCCATGGTCCTACTGCAG
ACCAGCCCATGCGACCAGTACGAGTGCCAGAACGGGGCCCAGTGCATCGTGGTGCAGCAGGAGCCCACCTGCCGC
TGCCCACCAGGCTTCGCCGGCCCCAGATGCGAGAAGCTCATCACTGTCAACTTCGTGGGCAAAGACTCCTACGTG
GAACTGGCCTCCGCCAAGGTCCGACCCCAGGCCAACATCTCCCTGCAGGTGGCCACTGACAAGGACAACGGCATC
CTTCTCTACAAAGGAGACAATGACCCCCTGGCACTGGAGCTGTACCAGGGCCACGTGCGGCTGGTCTATGACAGC
CTGAGTTCCCCTCCAACCACAGTGTACAGTGTGGAGACAGTGAATGATGGGCAGTTTCACAGTGTGGAGCTGGTG
ACGCTAAACCAGACCCTGAACCTAGTAGTGGACAAAGGAACTCCAAAGAGCCTGGGGAAGCTCCAGAAGCAGCCA
GCAGTGGGCATCAACAGCCCCCTCTACCTTGGAGGCATCCCCACCTCCACCGGCCTCTCCGCCTTGCGCCAGGGC
ACGGACCGGCCTCTAGGCGGCTTCCACGGATGCATCCATGAGGTGCGCATCAACAACGAGCTGCAGGACTTCAAG
GCCCTCCCACCACAGTCCCTGGGGGTGTCACCAGGCTGCAAGTCCTGCACCGTGTGCAAGCACGGCCTGTGCCGC
TCCGTGGAGAAGGACAGCGTGGTGTGCGAGTGCCGCCCAGGCTGGACCGGCCCACTCTGCGACCAGGAGGCCCGG
GACCCCTGCCTCGGCCACAGATGCCACCATGGAAAATGTGTGGCAACTGGGACCTCATACATGTGCAAGTGTGCC
GAGGGCTATGGAGGGGACTTGTGTGACAACAAGAATGACTCTGCCAATGCCTGCTCAGCCTTCAAGTGTCACCAT
GGGCAGTGCCACATCTCAGACCAAGGGGAGCCCTACTGCCTGTGCCAGCCCGGCTTTAGCGGCGAGCACTGCCAA
CAAGAGAATCCGTGCCTGGGACAAGTAGTCCGAGAGGTGATCCGCCGCCAGAAAGGTTATGCATCATGTGCCACA
GCCTCCAAGGTGCCCATCATGGAATGTCGTGGGGGCTGTGGGCCCCAGTGCTGCCAGCCCACCCGCAGCAAGCGG
CGGAAATACGTCTTCCAGTGCACGGACGGCTCCTCGTTTGTAGAAGAGGTGGAGAGACACTTAGAGTGCGGCTGC
CTCGCGTGTTCCTAAGCCCCTGCCCGCCTGCCTGCCACCTCTCGGACTCCAGCTTGATGGAGTTGGGACAGCCAT
GTGGGACCCCCTGGTGATTCAGCATGAAGGAAATGAAGCTGGAGAGGAAGGTAAAGAAGAAGAGAATATTAAGTA
TATTGTAAAATAAACAAAAAATAGAACTTAAAAAAAAAAAAAAAAAAAAAAA

FIGURE 290

MAPGWAGVGAAVRARLALALALASVLSGPPAVACPTKCTCSAASVDCHGLGLRAVPRGIPRNAERLDLDRNNITR
ITKMDFAGLKNLRVLHLEDNQVSVIERGAFQDLKQLERLRLNKNKLQVLPELLFQSTPKLTRLDLSENQIQGIPR
KAFRGITDVKNLQLDNNHISCIEDGAFRALRDLEILTLNNNNISRILVTSFNHMPKIRTLRLHSNHLYCDCHLAW
LSDWLRQRRTVGQFTLCMAPVHLRGFNVADVQKKEYVCPAPHSEPPSCNANSISCPSPCTCSNNIVDCRGKGLME
IPANLPEGIVEIRLEQNSIKAIPAGAFTQYKKLKRIDISKNQISDIAPDAFQGLKSLTSLVLYGNKITEIAKGLF
DGLVSLQLLLLNANKINCLRVNTFQDLQNLNLLSLYDNKLQTISKGLFAPLQSIQTLHLAQNPFVCDCHLKWLAD
YLQDNPIETSGARCSSPRRLANKRISQIKSKKFRCSGSEDYRSRFSSECFMDLVCPEKCRCEGTIVDCSNQKLVR
IPSHLPEYVTDLRLNDNEVSVLEATGIFKKLPNLRKINLSNNKIKEVREGAFDGAASVQELMLTGNQLETVHGRV
FRGLSGLKTLMLRSNLISCVSNDTFAGLSSVRLLSLYDNRITTITPGAFTTLVSLSTINLLSNPFNCNCHLAWLG
KWLRKRRIVSGNPRCQKPFFLKEIPIQDVAIQDFTCDGNEESSCQLSPRCPEQCTCMETVVRCSNKGLRALPRGM
PKDVTELYLEGNHLTAVPRELSALRHLTLIDLSNNSISMLTNYTFSNMSHLSTLILSYNRLRCIPVHAFNGLRSL
RVLTLHGNDISSVPEGSFNDLTSLSHLALGTNPLHCDCSLRWLSEWVKAGYKEPGIARCSSPEPMADRLLLTTPT
HRFQCKGPVDINIVAKCNACLSSPCKNNGTCTQDPVELYRCACPYSYKGKDCTVPINTCIQNPCQHGGTCHLSDS
HKDGFSCSCPLGFEGQRCEINPDDCEDNDCENNATCVDGINNYVCICPPNYTGELCDEVIDHCVPELNLCQHEAK
CIPLDKGFSCECVPGYSGKLCETDNDDCVAHKCRHGAQCVDTINGYTCTCPQGFSGPFCEHPPPMVLLQTSPCDQ
YECQNGAQCIVVQQEPTCRCPPGFAGPRCEKLITVNFVGKDSYVELASAKVRPQANISLQVATDKDNGILLYKGD
NDPLALELYQGHVRLVYDSLSSPPTTVYSVETVNDGQFHSVELVTLNQTLNLVVDKGTPKSLGKLQKQPAVGINS
PLYLGGIPTSTGLSALRQGTDRPLGGFHGCIHEVRINNELQDFKALPPQSLGVSPGCKSCTVCKHGLCRSVEKDS
VVCECRPGWTGPLCDQEARDPCLGHRCHHGKCVATGTSYMCKCAEGYGGDLCDNKNDSANACSAFKCHHGQCHIS
DQGEPYCLCQPGFSGEHCQQENPCLGQVVREVIRRQKGYASCATASKVPIMECRGGCGPQCCQPTRSKRRKYVFQ
CTDGSSFVEEVERHLECGCLACS

Signal peptide:
amino acids 1-27

FIGURE 291

GGATGCAGGACGCTCCCCTGAGCTGCCTGTCACCGACTAGGTGGAGCAGTGTTTCTTCCGCAGACTCAACTGAGA
AGTCAGCCTCTGGGGCAGGCACCAGGAATCTGCCTTTTCAGTTCTGTCTCCGGCAGGCTTTGAGGATGAAGGCTG
CGGGCATTCTGACCCTCATTGGCTGCCTGGTCACAGGCGCCGAGTCCAAAATCTACACTCGTTGCAAACTGGCAA
AAATATTCTCGAGGGCTGGCCTGGACAATTACTGGGGCTTCAGCCTTGGAAACTGGATCTGCATGGCATATTATG
AGAGCGGCTACAACACCACAGCCCCGACGGTCCTGGATGACGGCAGCATCGACTATGGCATCTTCCAGATCAACA
GCTTCGCGTGGTGCAGACGCGGAAAGCTGAAGGAGAACAACCACTGCCATGTCGCCTGCTCAGCCTTGATCACTG
ATGACCTCACAGATGCAATTATCTGTGCCAGGAAAATTGTTAAAGAGACACAAGGAATGAACTATTGGCAAGGCT
GGAAGAAACATTGTGAGGGCAGAGACCTGTCCGAGTGGAAAAAAGGCTGTGAGGTTTCCTAAACTGGAACTGGAC
CCAGGATGCTTTGCAGCAACGCCCTAGGATTTGCAGTGAATGTCCAAATGCCTGTGTCATCTTGTCCCGTTTCCT
CCCAATATTCCTTCTCAAACTTGGAGAGGGAAAATTAAGCTATACTTTTAAGAAAATAAATATTTCCATTTAAATGTC

FIGURE 292

MKAAGILTLIGCLVTGAESKIYTRCKLAKIFSRAGLDNYWGFSLGNWICMAYYESGYNTTAPTVLDDGSIDYGIF
QINSFAWCRRGKLKENNHCHVACSALITDDLTDAIICARKIVKETQGMNYWQGWKKHCEGRDLSEWKKGCEVS

Signal peptide:
amino acids 1-19

FIGURE 293

AGAAAGCTGCACTCTGTTGAGCTCCAGGGCGCAGTGGAGGGAGGGAGTGAAGGAGCTCTCTGTACCCAAGGAAAG
TGCAGCTGAGACTCAGACAAGATTACAATGAACCAACTCAGCTTCCTGCTGTTTCTCATAGCGACCACCAGAGGA
TGGAGTACAGATGAGGCTAATACTTACTTCAAGGAATGGACCTGTTCTTCGTCTCCATCTCTGCCCAGAAGCTGC
AAGGAAATCAAAGACGAATGTCCTAGTGCATTTGATGGCCTGTATTTTCTCCGCACTGAGAATGGTGTTATCTAC
CAGACCTTCTGTGACATGACCTCTGGGGGTGGCGGCTGGACCCTGGTGGCCAGCGTGCATGAGAATGACATGCGT
GGGAAGTGCACGGTGGGCGATCGCTGGTCCAGTCAGCAGGGCAGCAAAGCAGACTACCCAGAGGGGGACGGCAAC
TGGGCCAACTACAACACCTTTGGATCTGCAGAGGCGGCCACGAGCGATGACTACAAGAACCCTGGCTACTACGAC
ATCCAGGCCAAGGACCTGGGCATCTGGCACGTGCCCAATAAGTCCCCCATGCAGCACTGGAGAAACAGCTCCCTG
CTGAGGTACCGCACGGACACTGGCTTCCTCCAGACACTGGGACATAATCTGTTTGGCATCTACCAGAAATATCCA
GTGAAATATGGAGAAGGAAAGTGTTGGACTGACAACGGCCCGGTGATCCCTGTGGTCTATGATTTTGGCGACGCC
CAGAAAACAGCATCTTATTACTCACCCTATGGCCAGCGGGAATTCACTGCGGGATTTGTTCAGTTCAGGGTATTT
AATAACGAGAGAGCAGCCAACGCCTTGTGTGCTGGAATGAGGGTCACCGGATGTAACACTGAGCATCACTGCATT
GGTGGAGGAGGATACTTTCCAGAGGCCAGTCCCCAGCAGTGTGGAGATTTTTCTGGTTTTGATTGGAGTGGATAT
GGAACTCATGTTGGTTACAGCAGCAGCCGTGAGATAACTGAGGCAGCTGTGCTTCTATTCTATCGTTGAGAGTTT
TGTGGGAGGGAACCCAGACCTCTCCTCCCAACCATGAGATCCCAAGGATGGAGAACAACTTACCCAGTAGCTAGA
ATGTTAATGGCAGAAGAGAAAACAATAAATCATATTGACTCAAGAAAAAAA

FIGURE 294

MNQLSFLLFLIATTRGWSTDEANTYFKEWTCSSSPSLPRSCKEIKDECPSAFDGLYFLRTENGVIYQTFCDMTSG
GGGWTLVASVHENDMRGKCTVGDRWSSQQGSKADYPEGDGNWANYNTFGSAEAATSDDYKNPGYYDIQAKDLGIW
HVPNKSPMQHWRNSSLLRYRTDTGFLQTLGHNLFGIYQKYPVKYGEGKCWTDNGPVIPVVYDFGDAQKTASYYSP
YGQREFTAGFVQFRVFNNERAANALCAGMRVTGCNTEHHCIGGGGYFPEASPQQCGDFSGFDWSGYGTHVGYSSS
REITEAAVLLFYR

FIGURE 295

CAGGCCATTTGCATCCCACTGTCCTTGTGTTCGGAGCCAGGCCACACCGTCCTCAGCAGTGTCATGTGTTAAAAA
CGCCAAGCTGAATATATCATGCCCCTATTAAAACTTGTACATGGCTCCCCATTGGTTTTTGGAGAAAAGTTCAAG
CTTTTTACCTTGGTGTCTGCCTGTATCCCAGTGTTCAGGCTGGCTAGACGGCGGAAGAAGATCCTATTTTACTGT
CACTTCCCAGATCTGCTTCTCACCAAGAGAGATTCTTTTCTTAAACGACTATACAGGGCCCCAATTGACTGGATA
GAGGAATACACCACAGGCATGGCAGACTGCATCTTAGTCAACAGCCAGTTCACAGCTGCTGTTTTTAAGGAAACA
TTCAAGTCCCTGTCTCACATAGACCCTGATGTCCTCTATCCATCTCTAAATGTCACCAGCTTTGACTCAGTTGTT
CCTGAAAAGCTGGATGACCTAGTCCCCAAGGGGAAAAAATTCCTGCTGCTCTCCATCAACAGATACGAAAGGAAG
AAAAATCTGACTTTGGCACTGGAAGCCCTAGTACAGCTGCGTGGAAGATTGACATCCCAAGATTGGGAGAGGGTT
CATCTGATCGTGGCAGGTGGTTATGACGAGAGAGTCCTGGAGAATGTGGAACATTATCAGGAATTGAAGAAAATG
GTCCAACAGTCCGACCTTGGCCAGTATGTGACCTTCTTGAGGTCTTTCTCAGACAAACAGAAAATCTCCCTCCTC
CACAGCTGCACGTGTGTGCTTTACACACCAAGCAATGAGCACTTTGGCATTGTCCCTCTGGAAGCCATGTACATG
CAGTGCCCAGTCATTGCTGTTAATTCGGGTGGACCCTTGGAGTCCATTGACCACAGTGTCACAGGGTTTCTGTGT
GAGCCTGACCCGGTGCACTTCTCAGAAGCAATAGAAAAGTTCATCCGTGAACCTTCCTTAAAAGCCACCATGGGC
CTGGCTGGAAGAGCCAGAGTGAAGGAAAAATTTTCCCCTGAAGCATTTACAGAACAGCTCTACCGATATGTTACC
AAACTGCTGGTATAATCAGATTGTTTTTAAGATCTCCATTAATGTCATTTTTATGGATTGTAGACCCAGTTTTGA
AACCAAAAAAGAAACCTAGAATCTAATGCAGAAGAGATCTTTTAAAAAATAAACTTGAGTCTTGAATGTGAGCCA
CTTTCCTATATACCACACCTCCCTGTCCACTTTTCAGAAAAACCATGTCTTTTATGCTATAATCATTCCAAATTT
TGCCAGTGTTAAGTTACAAATGTGGTGTCATTCCATGTTCAGCAGAGTATTTTAATTATATTTTCTCGGGATTAT
TGCTCTTCTGTCTATAAATTTTGAATGATACTGTGCCTTAATTGGTTTTCATAGTTTAAGTGTGTATCATTATCA
AAGTTGATTAATTTGGCTTCATAGTATAATGAGAGCAGGGCTATTGTAGTTCCCAGATTCAATCCACCGAAGTGT
TCACTGTCATCTGTTAGGGAATTTTTGTTTGTCCTGTCTTTGCCTGGATCCATAGCGAGAGTGCTCTGTATTTTT
TTTAAGATAATTTGTATTTTTGCACACTGAGATATAATAAAAGGTGTTTATCATAAAAAAAAAAAAAAAAAA

FIGURE 296

MPLLKLVHGSPLVFGEKFKLFTLVSACIPVFRLARRRKKILFYCHFPDLLLTKRDSFLKRLYRAPIDWIEEYTTG
MADCILVNSQFTAAVFKETFKSLSHIDPDVLYPSLNVTSFDSVVPEKLDDLVPKGKKFLLLSINRYERKKNLTLA
LEALVQLRGRLTSQDWERVHLIVAGGYDERVLENVEHYQELKKMVQQSDLGQYVTFLRSFSDKQKISLLHSCTCV
LYTPSNEHFGIVPLEAMYMQCPVIAVNSGGPLESIDHSVTGFLCEPDPVHFSEAIEKFIREPSLKATMGLAGRAR
VKEKFSPEAFTEQLYRYVTKLLV

Signal peptide:

amino acids 1-15

FIGURE 297

GACTACGCCGATCCGAGACGTGGCTCCCTGGGCGGCAGAACCATGTTGGACTTCGCGATCTTCGCCGTTACCTTC
TTGCTGGCGTTGGTGGGAGCCGTGCTCTACCTCTATCCGGCTTCCAGACAAGCTGCAGGAATTCCAGGGATTACT
CCAACTGAAGAAAAAGATGGTAATCTTCCAGATATTGTGAATAGTGGAAGTTTGCATGAGTTCCTGGTTAATTTG
CATGAGAGATATGGGCCTGTGGTCTCCTTCTGGTTTGGCAGGCGCCTCGTGGTTAGTTTGGGCACTGTTGATGTA
CTGAAGCAGCATATCAATCCCAATAAGACATCGGACCCTTTTGAAACCATGCTGAAGTCATTATTAAGGTATCAA
TCTGGTGGTGGCAGTGTGAGTGAAAACCACATGAGGAAAAAATTGTATGAAAATGGTGTGACTGATTCTCTGAAG
AGTAACTTTGCCCTCCTCCTAAAGCTTTCAGAAGAATTATTAGATAAATGGCTCTCCTACCCAGAGACCCAGCAC
GTGCCCCTCAGCCAGCATATGCTTGGTTTTGCTATGAAGTCTGTTACACAGATGGTAATGGGTAGTACATTTGAA
GATGATCAGGAAGTCATTCGCTTCCAGAAGAATCATGGCACAGTTTGGTCTGAGATTGGAAAAGGCTTTCTAGAT
GGGTCACTTGATAAAAACATGACTCGGAAAAAACAATATGAAGATGCCCTCATGCAACTGGAGTCTGTTTTAAGG
AACATCATAAAAGAACGAAAAGGAAGGAACTTCAGTCAACATATTTTCATTGACTCCTTAGTACAAGGGAACCTT
AATGACCAACAGATCCTAGAAGACAGTATGATATTTTCTCTGGCCAGTTGCATAATAACTGCAAAATTGTGTACC
TGGGCAATCTGTTTTTTAACCACCTCTGAAGAAGTTCAAAAAAAATTATATGAAGAGATAAACCAAGTTTTTGGA
AATGGTCCTGTTACTCCAGAGAAAATTGAGCAGCTCAGATATTGTCAGCATGTGCTTTGTGAAACTGTTCGAACT
GCCAAACTGACTCCAGTTTCTGCCCAGCTTCAAGATATTGAAGGAAAAATTGACCGATTTATTATTCCTAGAGAG
ACCCTCGTCCTTTATGCCCTTGGTGTGGTACTTCAGGATCCTAATACTTGGCCATCTCCACACAAGTTTGATCCA
GATCGGTTTGATGATGAATTAGTAATGAAAACTTTTTCCTCACTTGGATTCTCAGGCACACAGGAGTGTCCAGAG
TTGAGGTTTGCATATATGGTGACCACAGTACTTCTTAGTGTATTGGTGAAGAGACTGCACCTACTTTCTGTGGAG
GGACAGGTTATTGAAACAAAGTATGAACTGGTAACATCATCAAGGGAAGAAGCTTGGATCACTGTCTCAAAGAGA
TATTAAAATTTTATACATTTAAAATCATTGTTAAATTGATTGAGGAAAACAACCATTTAAAAAAAATCTATGTTG
AATCCTTTTATAAACCAGTATCACTTTGTAATATAAACACCTATTTGTACTTAA

FIGURE 298

MLDFAIFAVTFLLALVGAVLYLYPASRQAAGIPGITPTEEKDGNLPDIVNSGSLHEFLVNLHERYGPVVSFWFGR
RLVVSLGTVDVLKQHINPNKTSDPFETMLKSLLRYQSGGGSVSENHMRKKLYENGVTDSLKSNFALLLKLSEELL
DKWLSYPETQHVPLSQHMLGFAMKSVTQMVMGSTFEDDQEVIRFQKNHGTVWSEIGKGFLDGSLDKNMTRKKQYE
DALMQLESVLRNIIKERKGRNFSQHIFIDSLVQGNLNDQQILEDSMIFSLASCIITAKLCTWAICFLTTSEEVQK
KLYEEINQVFGNGPVTPEKIEQLRYCQHVLCETVRTAKLTPVSAQLQDIEGKIDRFIIPRETLVLYALGVVLQDP
NTWPSPHKFDPDRFDDELVMKTFSSLGFSGTQECPELRFAYMVTTVLLSVLVKRLHLLSVEGQVIETKYELVTSS
REEAWITVSKRY

Signal peptide:
amino acids 1-18

Transmembrane domain:
amino acids 271-290

FIGURE 299

CTAGATTTGTCGGCTTGCGGGGAGACTTCAGGAGTCGCTGTCTCTGAACTTCCAGCCTCAGAGACCGCCGCCCTT
GTCCCCGAGGGCCATGGGCCGGGTCTCAGGGCTTGTGCCCTCTCGCTTCCTGACGCTCCTGGCGCATCTGGTGGT
CGTCATCACCTTATTCTGGTCCCGGGACAGCAACATACAGGCCTGCCTGCCTCTCACGTTCACCCCCGAGGAGTA
TGACAAGCAGGACATTCAGCTGGTGGCCGCGCTCTCTGTCACCCTGGGCCTCTTTGCAGTGGAGCTGGCCGGTTT
CCTCTCAGGAGTCTCCATGTTCAACAGCACCCAGAGCCTCATCTCCATTGGGGCTCACTGTAGTGCATCCGTGGC
CCTGTCCTTCTTCATATTCGAGCGTTGGGAGTGCACTACGTATTGGTACATTTTTGTCTTCTGCAGTGCCCTTCC
AGCTGTCACTGAAATGGCTTTATTCGTCACCGTCTTTGGGCTGAAAAAGAAACCCTTCTGATTACCTTCATGACG
GGAACCTAAGGACGAAGCCTACAGGGGCAAGGGCCGCTTCGTATTCCTGGAAGAAGGAAGGCATAGGCTTCGGTT
TTCCCCTCGGAAACTGCTTCTGCTGGAGGATATGTGTTGGAATAATTACGTCTTGAGTCTGGGATTATCCGCATT
GTATTTAGTGCTTTGTAATAAAATATGTTTTGTAGTAACATTAAGACTTATATACAGTTTTAGGGGACAATTAAA
AAAAAAAAA

FIGURE 300

MGRVSGLVPSRFLTLLAHLVVVITLFWSRDSNIQACLPLTFTPEEYDKQDIQLVAALSVTLGLFAVELAGFLSGV
SMFNSTQSLISIGAHCSASVALSFFIFERWECTTYWYIFVFCSALPAVTEMALFVTVFGLKKKPF

Transmembrane domain:

amino acids 12-28 (type II), 51-66, 107-124

FIGURE 301

CTGGGACCCCGAAAAGAGAAGGGGAGAGCGAGGGGACGAGAGCGGAGGAGGAAGATGCAACTGACTCGCTGCTGC
TTCGTGTTCCTGGTGCAGGGTAGCCTCTATCTGGTCATCTGTGGCCAGGATGATGGTCCTCCCGGCTCAGAGGAC
CCTGAGCGTGATGACCACGAGGGCCAGCCCCGGCCCCGGGTGCCTCGGAAGCGGGGCCACATCTCACCTAAGTCC
CGCCCCATGGCCAATTCCACTCTCCTAGGGCTGCTGGCCCCGCCTGGGGAGGCTTGGGGCATTCTTGGGCAGCCC
CCCAACCGCCCGAACCACAGCCCCCCACCCTCAGCCAAGGTGAAGAAAATCTTTGGCTGGGGCGACTTCTACTCC
AACATCAAGACGGTGGCCCTGAACCTGCTCGTCACAGGGAAGATTGTGGACCATGGCAATGGGACCTTCAGCGTC
CACTTCCAACACAATGCCACAGGCCAGGGAAACATCTCCATCAGCCTCGTGCCCCCCAGTAAAGCTGTAGAGTTC
CACCAGGAACAGCAGATCTTCATCGAAGCCAAGGCCTCCAAAATCTTCAACTGCCGGATGGAGTGGGAGAAGGTA
GAACGGGGCCGCCGGACCTCGCTTTGCACCCACGACCCAGCCAAGATCTGCTCCCGAGACCACGCTCAGAGCTCA
GCCACCTGGAGCTGCTCCCAGCCCTTCAAAGTCGTCTGTGTCTACATCGCCTTCTACAGCACGGACTATCGGCTG
GTCCAGAAGGTGTGCCCAGATTACAACTACCATAGTGATACCCCCTACTACCCATCTGGGTGACCCGGGGCAGGC
CACAGAGGCCAGGCCAGGGCTGGAAGGACAGGCCTGCCCATGCAGGAGACCATCTGGACACCGGGCAGGGAAGGG
GTTGGGCCTCAGGCAGGGAGGGGGGTGGAGACGAGGAGATGCCAAGTGGGGCCAGGGCCAAGTCTCAAGTGGCAG
AGAAAGGGTCCCAAGTGCTGGTCCCAACCTGAAGCTGTGGAGTGACTAGATCACAGGAGCACTGGAGGAGGAGTG
GGCTCTCTGTGCAGCCTCACAGGGCTTTGCCACGGAGCCACAGAGAGATGCTGGGTCCCCGAGGCCTGTGGGCAG
GCCGATCAGTGTGGCCCCAGATCAAGTCATGGGAGGAAGCTAAGCCCTTGGTTCTTGCCATCCTGAGGAAAGATA
GCAACAGGGAGGGGGAGATTTCATCAGTGTGGACAGCCTGTCAACTTAGGATGGATGGCTGAGAGGGCTTCCTAG
GAGCCAGTCAGCAGGGTGGGGTGGGGCCAGAGGAGCTCTCCAGCCCTGCCTAGTGGGCGCCCTGAGCCCCTTGTC
GTGTGCTGAGCATGGCATGAGGCTGAAGTGGCAACCCTGGGGTCTTTGATGTCTTGACAGATTGACCATCTGTCT
CCAGCCAGGCCACCCCTTTCCAAAATTCCCTCTTCTGCCAGTACTCCCCCTGTACCACCCATTGCTGATGGCACA
CCCATCCTTAAGCTAAGACAGGACGATTGTGGTCCTCCCACACTAAGGCCACAGCCCATCCGCGTGCTGTGTGTC
CCTCTTCCACCCCAACCCCTGCTGGCTCCTCTGGGAGCATCCATGTCCCGGAGAGGGGTCCCTCAACAGTCAGCC
TCACCTGTCAGACCGGGGTTCTCCCGGATCTGGATGGCGCCGCCCCTCTCAGCAGCGGGCACGGGTGGGGCGGGGC
CGGGCCGCAGAGCATGTGCTGGATCTGTTCTGTGTGTCTGTCTGTGGGTGGGGGGAGGGGAGGGAAGTCTTGTGA
AACCGCTGATTGCTGACTTTTGTGTGAAGAATCGTGTTCTTGGAGCAGGAAATAAAGCTTGCCCCGGGGCA

FIGURE 302

></usr/seqdb2/sst/DNA/Dnaseqs.min/ss.DNA66521
><subunit 1 of 1, 252 aa, 1 stop
><MW: 28127, pI: 8.91, NX(S/T): 5
MQLTRCCFVFLVQGSLYLVICGQDDGPPGSEDPERDDHEGQPRPRVPRKRGHISPKSRPMANSTLLGLLAPPGEA
WGILGQPPNRPNHSPPPSAKVKKIFGWGDFYSNIKTVALNLLVTGKIVDHGNGTFSVHFQHNATGQGNISISLVP
PSKAVEFHQEQQIFIEAKASKIFNCRMEWEKVERGRRTSLCTHDPAKICSRDHAQSSATWSCSQPFKVVCVYIAF
YSTDYRLVQKVCPDYNYHSDTPYYPSG

Important features of the protein:
Signal peptide:
amino acids 1-14

N-glycosylation sites.
amino acids 62-65, 127-130, 137-140, 143-146

2-oxo acid dehydrogenases acyltransferase
amino acids 61-71

FIGURE 303

CGGTGGCCATGACTGCGGCCGTGTTCTTCGGCTGCGCCTTCATTGCCTTCGGGCCTGCGCTCGCCCTTTATGTCT
TCACCATCGCCATCGAGCCGTTGCGTATCATCTTCCTCATCGCCGGAGCTTTCTTCTGGTTGGTGTCTCTACTGA
TTTCGTCCCTTGTTTGGTTCATGGCAAGAGTCATTATTGACAACAAAGATGGACCAACACAGAAATATCTGCTGA
TCTTTGGAGCGTTTGTCTCTGTCTATATCCAAGAAATGTTCCGATTTGCATATTATAAACTCTTAAAAAAAGCCA
GTGAAGGTTTGAAGAGTATAAACCCAGGTGAGACAGCACCCTCTATGCGACTGCTGGCCTATGTTTCTGGCTTGG
GCTTTGGAATCATGAGTGGAGTATTTTCCTTTGTGAATACCCTATCTGACTCCTTGGGGCCAGGCACAGTGGGCA
TTCATGGAGATTCTCCTCAATTCTTCCTTTATTCAGCTTTCATGACGCTGGTCATTATCTTGCTGCATGTATTCT
GGGGCATTGTATTTTTTGATGGCTGTGAGAAGAAAAAGTGGGGCATCCTCCTTATCGTTCTCCTGACCCACCTGC
TGGTGTCAGCCCAGACCTTCATAAGTTCTTATTATGGAATAAACCTGGCGTCAGCATTTATAATCCTGGTGCTCA
TGGGCACCTGGGCATTCTTAGCTGCGGGAGGCAGCTGCCGAAGCCTGAAACTCTGCCTGCTCTGCCAAGACAAGA
ACTTTCTTCTTTACAACCAGCGCTCCAGATAACCTCAGGGAACCAGCACTTCCCAAACCGCAGACTACATCTTTA
GAGGAAGCACAACTGTGCCTTTTTCTGAAAATCCCTTTTTCTGGTGGAATTGAGAAAGAAATAAAACTATGCAGATA

FIGURE 304

></usr/seqdb2/sst/DNA/Dnaseqs.min/ss.DNA66658
><subunit 1 of 1, 257 aa, 1 stop
><MW: 28472, pI: 9.33, NX(S/T): 0
MTAAVFFGCAFIAFGPALALYVFTIAIEPLRIIFLIAGAFFWLVSLLISSLVWFMARVIIDNKDGPTQKYLLIFG
AFVSVYIQEMFRFAYYKLLKKASEGLKSINPGETAPSMRLLAYVSGLGFGIMSGVFSFVNTLSDSLGPGTVGIHG
DSPQFFLYSAFMTLVIILLHVFWGIVFFDGCEKKKWGILLIVLLTHLLVSAQTFISSYYGINLASAFIILVLMGT
WAFLAAGGSCRSLKLCLLCQDKNFLLYNQRSR

Important features of the protein:

Signal peptide:

amino acids 1-19

Transmembrane domains:

amino acids 32-51, 119-138, 152-169, 216-235

Glycosaminoglycan attachment site.

amino acids 120-123

Sodium:neurotransmitter symporter family protein amino acids 31-65

FIGURE 305

AATTTTTCACCAGAGTAAACTTGAGAAACCAACTGGACCTTGAGTATTGTACATTTTGCCTCGTGGACCCAAAGG
TAGCAATCTGAAACATGAGGAGTACGATTCTACTGTTTTGTCTTCTAGGATCAACTCGGTCATTACCACAGCTCA
AACCTGCTTTGGGACTCCCTCCCACAAAACTGGCTCCGGATCAGGGAACACTACCAAACCAACAGCAGTCAAATC
AGGTCTTTCCTTCTTTAAGTCTGATACCATTAACACAGATGCTCACACTGGGGCCAGATCTGCATCTGTTAAATC
CTGCTGCAGGAATGACACCTGGTACCCAGACCCACCCATTGACCCTGGGAGGGTTGAATGTACAACAGCAACTGC
ACCCACATGTGTTACCAATTTTTGTCACACAACTTGGAGCCCAGGGCACTATCCTAAGCTCAGAGGAATTGCCAC
AAATCTTCACGAGCCTCATCATCCATTCCTTGTTCCCGGGAGGCATCCTGCCCACCAGTCAGGCAGGGGCTAATC
CAGATGTCCAGGATGGAAGCCTTCCAGCAGGAGGAGCAGGTGTAAATCCTGCCACCCAGGGAACCCCAGCAGGCC
GCCTCCCAACTCCCAGTGGCACAGATGACGACTTTGCAGTGACCACCCCTGCAGGCATCCAAAGGAGCACACATG
CCATCGAGGAAGCCACCACAGAATCAGCAAATGGAATTCAGTAAGCTGTTTCAAATTTTTTCAACTAAGCTGCCT
CGAATTTGGTGATACATGTGAATCTTTATCATTGATTATATTATGGAATAGATTGAGACACATTGGATAGTCTTA
GAAGAAATTAATTCTTAATTTACCTGAAAATATTCTTGAAATTTCAGAAAATATGTTCTATGTAGAGAATCCCAA
CTTTTAAAAACAATAATTCAATGGATAAATCTGTCTTTGAAATATAACATTATGCTGCCTGGATGATATGCATAT
TAAAACATATTTGGAAAACTGGAAAAAAAAAAAAAAAAAAAAAAAAAAAAAAAAAAAAAAAAAAAAAAAAAAAAAA
AAAAAAAAAAAAAAAAAAAAAAA

FIGURE 306

MRSTILLFCLLGSTRSLPQLKPALGLPPTKLAPDQGTLPNQQQSNQVFPSLSLIPLTQM
LTLGPDLHLLNPAAGMTPGTQTHPLTLGGLNVQQQLHPHVLPIFVTQLGAQGTILSSEE
LPQIFTSLIIHSLFPGGILPTSQAGANPDVQDGSLPAGGAGVNPATQGTPAGRLPTPSG
TDDDFAVTTPAGIQRSTHAIEEATTESANGIQ

Signal peptide:

amino acids 1-16

FIGURE 307

CCGGGGACATGAGGTGGATACTGTTCATTGGGGCCCTTATTGGGTCCAGCATCTGTGGCCAAGAAAAATTTTTTG
GGGACCAAGTTTTGAGGATTAATGTCAGAAATGGAGACGAGATCAGCAAATTGAGTCAACTAGTGAATTCAAACA
ACTTGAAGCTCAATTTCTGGAAATCTCCCTCCTCCTTCAATCGGCCTGTGGATGTCCTGGTCCCATCTGTCAGTC
TGCAGGCATTTAAATCCTTCCTGAGATCCCAGGGCTTAGAGTACGCAGTGACAATTGAGGACCTGCAGGCCCTTT
TAGACAATGAAGATGATGAAATGCAACACAATGAAGGGCAAGAACGGAGCAGTAATAACTTCAACTACGGGGCTT
ACCATTCCCTGGAAGCTATTTACCACGAGATGGACAACATTGCCGCAGACTTTCCTGACCTGGCGAGGAGGGTGA
AGATTGGACATTCGTTTGAAAACCGGCCGATGTATGTACTGAAGTTCAGCACTGGGAAAGGCGTGAGGCGGCCGG
CCGTTTGGCTGAATGCAGGCATCCATTCCCGAGAGTGGATCTCCCAGGCCACTGCAATCTGGACGGCAAGGAAGA
TTGTATCTGATTACCAGAGGGATCCAGCTATCACCTCCATCTTGGAGAAAATGGATATTTTCTTGTTGCCTGTGG
CCAATCCTGATGGATATGTGTATACTCAAACTCAAAACCGATTATGGAGGAAGACGCGGTCCCGAAATCCTGGAA
GCTCCTGCATTGGTGCTGACCCAAATAGAAACTGGAACGCTAGTTTTGCAGGAAAGGGAGCCAGCGACAACCCTT
GCTCCGAAGTGTACCATGGACCCCACGCCAATTCGGAAGTGGAGGTGAAATCAGTGGTAGATTTCATCCAAAAAC
ATGGGAATTTCAAGGGCTTCATCGACCTGCACAGCTACTCGCAGCTGCTGATGTATCCATATGGGTACTCAGTCA
AAAAGGCCCCAGATGCCGAGGAACTCGACAAGGTGGCGAGGCTTGCGGCCAAAGCTCTGGCTTCTGTGTCGGGCA
CTGAGTACCAAGTGGGTCCCACCTGCACCACTGTCTATCCAGCTAGCGGGAGCAGCATCGACTGGGCGTATGACA
ACGGCATCAAATTTGCATTCACATTTGAGTTGAGAGATACCGGGACCTATGGCTTCCTCCTGCCAGCTAACCAGA
TCATCCCCACTGCAGAGGAGACGTGGCTGGGGCTGAAGACCATCATGGAGCATGTGCGGGACAACCTCTACTAGG
CGATGGCTCTGCTCTGTCTACATTTATTTGTACCCACACGTGCACGCACTGAGGCCATTGTTAAAGGAGCTCTTT
CCTACCTGTGTGAGTCAGAGCCCTCTGGGTTTGTGGAGCACACAGGCCTGCCCCTCTCCAGCCAGCTCCCTGGAG
TCGTGTGTCCTGGCGGTGTCCCTGCAAGAACTGGTTCTGCCAGCCTGCTCAATTTTGGTCCTGCTGTTTTTGATG
AGCCTTTTGTCTGTTTCTCCTTCCACCCTGCTGGCTGGGCGGCTGCACTCAGCATCACCCCTTCCTGGGTGGCAT
GTCTCTCTCTACCTCATTTTTAGAACCAAAGAACATCTGAGATGATTCTCTACCCTCATCCACATCTAGCCAAGC
CAGTGACCTTGCTCTGGTGGCACTGTGGGAGACACCACTTGTCTTTAGGTGGGTCTCAAAGATGATGTAGAATTT
CCTTTAATTTCTCGCAGTCTTCCTGGAAAATATTTTCCTTTGAGCAGCAAATCTTGTAGGGATATCAGTGAAGGT
CTCTCCCTCCCTCCTCTCCTGTTTTTTTTTTTTTTGAGACAGAGTTTTGCTCTTGTTGCCCAGGCTGGAGTGTGA
TGGCTCGATCTTGGCTCACCACAACCTCTGCCTCCTGGGTTCAAGCAATTCTCCTGCCTCAGCCTCTTGAGTAGC
TTGGTTTATAGGCGCATGCCACCATGCCTGGCTAATTTTGTGTTTTTAGTAGAGACAGGGTTTCTCCATGTTGGT
CAGGCTGGTCTCAAACTCCCAACCTCAGGTGATCTGCCCTCCTTGGCCTCCCAGAGTGCTGGGATTACAGGTGTG
AGCCACTGTGCCGGGCCCGTCCCCTCCTTTTTTAGGCCTGAATACAAAGTAGAAGATCACTTTCCTTCACTGTGC
TGAGAATTTCTAGATACTACAGTTCTTACTCCTCTCTTCCCTTTGTTATTCAGTGTGACCAGGATGGCGGGAGGG
GATCTGTGTCACTGTAGGTACTGTGCCCAGGAAGGCTGGGTGAAGTGACCATCTAAATTGCAGGATGGTGAAATT
ATCCCCATCTGTCCTAATGGGCTTACCTCCTCTTTGCCTTTTGAACTCACTTCAAAGATCTAGGCCTCATCTTAC
AGGTCCTAAATCACTCATCTGGCCTGGATAATCTCACTGCCCTGGCACATTCCCATTTGTGCTGTGGTGTATCCT
GTGTTTCCTTGTCCTGGTTTGTGTGTGTGTGTGTGTGTGTGTGTGTGTGTGTTTGTGTGTGTGTCTGTCTA
TTTTGTATCCTGGACCACAAGTTCCTAAGTAGAGCAAGAATTCATCAACCAGCTGCCTCTTGTTTCATTTCACCT
CAGCACGTACCATCTGTCCTTTTGTTGTTGTTGTTTTGTTTTTGTTTTTTTGCTTTTACCAAACATGTCTGTAAA
TCTTAACCTCCTGCCTAGGATTTGTACAGCATCTGGTGTGTGCTTATAAGCCAATAAATATTCAATGTGAAAAAA
AAAAAAAAAAA

FIGURE 308

MRWILFIGALIGSSICGQEKFFGDQVLRINVRNGDEISKLSQLVNSNNLKLNFWKSPSSFNRPVDVLVPSVSLQA
FKSFLRSQGLEYAVTIEDLQALLDNEDDEMQHNEGQERSSNNFNYGAYHSLEAIYHEMDNIAADFPDLARRVKIG
HSFENRPMYVLKFSTGKGVRRPAVWLNAGIHSREWISQATAIWTARKIVSDYQRDPAITSILEKMDIFLLPVANP
DGYVYTQTQNRLWRKTRSRNPGSSCIGADPNRNWNASFAGKGASDNPCSEVYHGPHANSEVEVKSVVDFIQKHGN
FKGFIDLHSYSQLLMYPYGYSVKKAPDAEELDKVARLAAKALASVSGTEYQVGPTCTTVYPASGSSIDWAYDNGI
KFAFTFELRDTGTYGFLLPANQIIPTAEETWLGLKTIMEHVRDNLY

Signal peptide:
amino acids 1-16

FIGURE 309

GGCTGACCGTGCTACATTGCCTGGAGGAAGCCTAAGGAACCCAGGCATCCAGCTGCCCACGCCTGAGTCCAAGAT
TCTTCCCAGGAACACAAACGTAGGAGACCCACGCTCCTGGAAGCACCAGCCTTTATCTCTTCACCTTCAAGTCCC
CTTTCTCAAGAATCCTCTGTTCTTTGCCCTCTAAAGTCTTGGTACATCTAGGACCCAGGCATCTTGCTTTCCAGC
CACAAAGAGACAG<u>ATG</u>AAGATGCAGAAAGGAAATGTTCTCCTTATGTTTGGTCTACTATTGCATTTAGAAGCTGC
AACAAATTCCAATGAGACTAGCACCTCTGCCAACACTGGATCCAGTGTGATCTCCAGTGGAGCCAGCACAGCCAC
CAACTCTGGGTCCAGTGTGACCTCCAGTGGGGTCAGCACAGCCACCATCTCAGGGTCCAGCGTGACCTCCAATGG
GGTCAGCATAGTCACCAACTCTGAGTTCCATACAACCTCCAGTGGGATCAGCACAGCCACCAACTCTGAGTTCAG
CACAGCGTCCAGTGGGATCAGCATAGCCACCAACTCTGAGTCCAGCACAACCTCCAGTGGGGCCAGCACAGCCAC
CAACTCTGAGTCCAGCACACCCTCCAGTGGGGCCAGCACAGTCACCAACTCTGGGTCCAGTGTGACCTCCAGTGG
AGCCAGCACTGCCACCAACTCTGAGTCCAGCACAGTGTCCAGTAGGGCCAGCACTGCCACCAACTCTGAGTCTAG
CACACTCTCCAGTGGGGCCAGCACAGCCACCAACTCTGACTCCAGCACAACCTCCAGTGGGGCTAGCACAGCCAC
CAACTCTGAGTCCAGCACAACCTCCAGTGGGGCCAGCACAGCCACCAACTCTGAGTCCAGCACAGTGTCCAGTAG
GGCCAGCACTGCCACCAACTCTGAGTCCAGCACAACCTCCAGTGGGGCCAGCACAGCCACCAACTCTGAGTCCAG
AACGACCTCCAATGGGGCTGGCACAGCCACCAACTCTGAGTCCAGCACGACCTCCAGTGGGGCCAGCACAGCCAC
CAACTCTGACTCCAGCACAGTGTCCAGTGGGGCCAGCACTGCCACCAACTCTGAGTCCAGCACGACCTCCAGTGG
GGCCAGCACAGCCACCAACTCTGAGTCCAGCACGACCTCCAGTGGGGCTAGCACAGCCACCAACTCTGACTCCAG
CACAACCTCCAGTGGGGCCGGCACAGCCACCAACTCTGAGTCCAGCACAGTGTCCAGTGGGATCAGCACAGTCAC
CAATTCTGAGTCCAGCACACCCTCCAGTGGGGCCAACACAGCCACCAACTCTGAGTCCAGTACGACCTCCAGTGG
GGCCAACACAGCCACCAACTCTGAGTCCAGCACAGTGTCCAGTGGGGCCAGCACTGCCACCAACTCTGAGTCCAG
CACAACCTCCAGTGGGGTCAGCACAGCCACCAACTCTGAGTCCAGCACAACCTCCAGTGGGGCTAGCACAGCCAC
CAACTCTGACTCCAGCACAACCTCCAGTGAGGCCAGCACAGCCACCAACTCTGAGTCTAGCACAGTGTCCAGTGG
GATCAGCACAGTCACCAATTCTGAGTCCAGCACAACCTCCAGTGGGGCCAACACAGCCACCAACTCTGGGTCCAG
TGTGACCTCTGCAGGCTCTGGAACAGCAGCTCTGACTGGAATGCACACAACTTCCCATAGTGCATCTACTGCAGT
GAGTGAGGCAAAGCCTGGTGGGTCCCTGGTGCCGTGGGAAATCTTCCTCATCACCCTGGTCTCGGTTGTGGCGGC
CGTGGGGCTCTTTGCTGGGCTCTTCTTCTGTGTGAGAAACAGCCTGTCCCTGAGAAACACCTTTAACACAGCTGT
CTACCACCCTCATGGCCTCAACCATGGCCTTGGTCCAGGCCCTGGAGGGAATCATGGAGCCCCCCACAGGCCCAG
GTGGAGTCCTAACTGGTTCTGGAGGAGACCAGTATCATCGATAGCCATGGAGATGAGCGGGAGGAACAGCGGGCC
C<u>TGA</u>GCAGCCCCGGAAGCAAGTGCCGCATTCTTCAGGAAGGAAGAGACCTGGGCACCCAAGACCTGGTTTCCTTT
CATTCATCCCAGGAGACCCCTCCCAGCTTTGTTTGAGATCCTGAAAATCTTGAAGAAGGTATTCCTCACCTTTCT
TGCCTTTACCAGACACTGGAAAGAGAATACTATATTGCTCATTTAGCTAAGAAATAAATACATCTCATCTAACAC
ACACGACAAAGAGAAGCTGTGCTTGCCCCGGGGTGGGTATCTAGCTCTGAGATGAACTCAGTTATAGGAGAAAAC
CTCCATGCTGGACTCCATCTGGCATTCAAAATCTCCACAGTAAAATCCAAAGACCTCAAAAAAAAAAAAA
AAAAAAAAAAAAAAAAAAAAAAAAAAAAAAAAA

FIGURE 310

MKMQKGNVLLMFGLLLHLEAATNSNETSTSANTGSSVISSGASTATNSGSSVTSSGVSTATIS
GSSVTSNGVSIVTNSEFHTTSSGISTATNSEFSTASSGISIATNSESSTTSSGASTATNSESS
TPSSGASTVTNSGSSVTSSGASTATNSESSTVSSRASTATNSESSTLSSGASTATNSDSSTTS
SGASTATNSESSTTSSGASTATNSESSTVSSRASTATNSESSTTSSGASTATNSESRTTSNGA
GTATNSESSTTSSGASTATNSDSSTVSSGASTATNSESSTTSSGASTATNSESSTTSSGASTA
TNSDSSTTSSGAGTATNSESSTVSSGISTVTNSESSTPSSGANTATNSESSTTSSGANTATNS
ESSTVSSGASTATNSESSTTSSGVSTATNSESSTTSSGASTATNSDSSTTSSEASTATNSESS
TVSSGISTVTNSESSTTSSGANTATNSGSSVTSAGSGTAALTGMHTTSHSASTAVSEAKPGGS
LVPWEIFLITLVSVVAAVGLFAGLFFCVRNSLSLRNTFNTAVYHPHGLNHGLGPGPGGNHGAP
HRPRWSPNWFWRRPVSSIAMEMSGRNSGP

Signal peptide:
amino acids 1-20

Transmembrane domain:
amino acids 510-532

FIGURE 311A

CTAAGCCGGAGGATGTGCAGCTGCGGCGGCGGCGCCGGCTACGAAGAGGACGGGGACAGGCGCCGTGCGAACCGA
GCCCAGCCAGCCGGAGGACGCGGGCAGGGCGGGACGGGAGCCCGGACTCGTCTGCCGCCGCCGTCGTCGCCGTCG
TGCCGGCCCCGCGTCCCCGCGCGCGAGCGGGAGGAGCCGCCGCCACCTCGCGCCCGAGCCGCCGCTAGCGCGCGC
CGGGCATGGTCCCCTCTTAAAGGCGCAGGCCGCGGCGGCGGGGGCGGGTGTGCGGAACAAAGCGCCGGCGCGGGG
CCTGCGGGCGGCTCGGGGGCCGCGATGGGCGCGGCGGGCCCGCGGCGGCGGCGGCGCTGCCCGGGCCGGGCCTCG
CGGCGCTAGGGCGGGCTGGCCTCCGTGGGCGGGGGCAGCGGGCTGAGGGCGCGCGGAGCCTGCGGCGGCGGCGGC
GGCGGCGGCGGCGGCCCGGCGGGCGGAGCGGCGCGGGC<u>ATG</u>GCCGCGCGCGGCCGGCGCGCCTGGCTCAGCGTGC
TGCTCGGGCTCGTCCTGGGCTTCGTGCTGGCCTCGCGGCTCGTCCTGCCCCGGGCTTCCGAGCTGAAGCGAGCGG
GCCCACGGCGCCGCGCCAGCCCCGAGGGCTGCCGGTCCGGGCAGGCGGCGGCTTCCCAGGCCGGCGGGGCGCGCG
GCGATGCGCGCGGGGCGCAGCTCTGGCCGCCCGGCTCGGACCCAGATGGCGGCCCGCGCGACAGGAACTTTCTCT
TCGTGGGAGTCATGACCGCCCAGAAATACCTGCAGACTCGGGCCGTGGCCGCCTACAGAACATGGTCCAAGACAA
TTCCTGGGAAAGTTCAGTTCTTCTCAAGTGAGGGTTCTGACACATCTGTACCAATTCCAGTAGTGCCACTACGGG
GTGTGGACGACTCCTACCCGCCCCAGAAGAAGTCCTTCATGATGCTCAAGTACATGCACGACCACTACTTGGACA
AGTATGAATGGTTTATGAGAGCAGATGATGACGTGTACATCAAAGGAGACCGTCTGGAGAACTTCCTGAGGAGTT
TGAACAGCAGCGAGCCCCTCTTTCTTGGGCAGACAGGCCTGGGCACCACGGAAGAAATGGGAAAACTGGCCCTGG
AGCCTGGTGAGAACTTCTGCATGGGGGGGCCTGGCGTGATCATGAGCCGGGAGGTGCTTCGGAGAATGGTGCCGC
ACATTGGCAAGTGTCTCCGGGAGATGTACACCACCCATGAGGACGTGGAGGTGGGAAGGTGTGTCCGGAGGTTTG
CAGGGGTGCAGTGTGTCTGGTCTTATGAGATGCGGCAGCTTTTTTATGAGAATTACGAGCAGAACAAAAAGGGGT
ACATTAGAGATCTCCATAACAGTAAAATTCACCAAGCTATCACATTACACCCCAACAAAAACCCACCCTACCAGT
ACAGGCTCCACAGCTACATGCTGAGCCGCAAGATATCCGAGCTCCGCCATCGCACAATACAGCTGCACCGCGAAA
TTGTCCTGATGAGCAAATACAGCAACACAGAAATTCATAAAGAGGACCTCCAGCTGGGAATCCCTCCCTCCTTCA
TGAGGTTTCAGCCCCGCCAGCGAGAGGAGATTCTGGAATGGGAGTTTCTGACTGGAAAATACTTGTATTCGGCAG
TTGACGGCCAGCCCCCTCGAAGAGGAATGGACTCCGCCCAGAGGGAAGCCTTGGACGACATTGTCATGCAGGTCA
TGGAGATGATCAATGCCAACGCCAAGACCAGAGGGCGCATCATTGACTTCAAAGAGATCCAGTACGGCTACCGCC
GGGTGAACCCCATGTATGGGGCTGAGTACATCCTGGACCTGCTGCTTCTGTACAAAAAGCACAAAGGGAAGAAAA
TGACGGTCCCTGTGAGGAGGCACGCGTATTTACAGCAGACTTTCAGCAAAATCCAGTTTGTGGAGCATGAGGAGC
TGGATGCACAAGAGTTGGCCAAGAGAATCAATCAGGAATCTGGATCCTTGTCCTTTCTCTCAAACTCCCTGAAGA
AGCTCGTCCCCTTTCAGCTCCCTGGGTCGAAGAGTGAGCACAAAGAACCCAAAGATAAAAAGATAAACATACTGA
TTCCTTTGTCTGGGCGTTTCGACATGTTTGTGAGATTTATGGGAAACTTTGAGAAGACGTGTCTTATCCCCAATC
AGAACGTCAAGCTCGTGGTTCTGCTTTTCAATTCTGACTCCAACCCTGACAAGGCCAAACAAGTTGAACTGATGA
GAGATTACCGCATTAAGTACCCTAAAGCCGACATGCAGATTTTGCCTGTGTCTGGAGAGTTTTCAAGAGCCCTGG
CCCTGGAAGTAGGATCCTCCCAGTTTAACAATGAATCTTTGCTCTTCTTCTGCGACGTCGACCTCGTGTTTACTA
CAGAATTCCTTCAGCGATGTCGAGCAAATACAGTTCTGGGCCAACAAATATATTTTCCAATCATCTTCAGCCAGT
ATGACCCAAAGATTGTTTATAGTGGGAAAGTTCCCAGTGACAACCATTTTGCCTTTACTCAGAAAACTGGCTTCT
GGAGAAACTATGGGTTTGGCATCACGTGTATTTATAAGGGAGATCTTGTCCGAGTGGGTGGCTTTGATGTTTCCA
TCCAAGGCTGGGGGCTGGAGGATGTGGACCTTTTCAACAAGGTTGTCCAGGCAGGTTTGAAGACGTTTAGGAGCC
AGGAAGTAGGAGTAGTCCACGTCCACCATCCTGTCTTTTGTGATCCCAATCTTGACCCCAAACAGTACAAAATGT
GCTTGGGGTCCAAAGCATCGACCTATGGGTCCACCCAGCAGCTGGCTGAGATGTGGCTGGAAAAAAATGATCCAA
GTTACAGTAAAAGCAGCAATAATAATGGCTCAGTGAGGACAGCC<u>TAA</u>TGTCCAGCTTTGCTGGAAAAGACGTTTT
TAATTATCTAATTTATTTTTCAAAAATTTTTTGTATGATCAGTTTTTGAAGTCCGTATACAAGGATATATTTTAC
AAGTGGTTTTCTTACATAGGACTCCTTTAAGATTGAGCTTTCTGAACAAGAAGGTGATCAGTGTTTGCCTTTGAA
CACATCTTCTTGCTGAACATTATGTAGCAGACCTGCTTAACTTTGACTTGAAATGTACCTGATGAACAAAACTTT
TTTAAAAAAATGTTTTCTTTTGAGACCCTTTGCTCCAGTCCTATGGCAGAAAACGTGAACATTCCTGCAAAGTAT
TATTGTAACAAAACACTGTAACTCTGGTAAATGTTCTGTTGTGATTGTTAACATTCCACAGATTCTACCTTTTGT
GTTTTGTTTTTTTTTTTTACAATTGTTTTAAAGCCATTTCATGTTCCAGTTGTAAGATAAGGAAATGTGATAATA
GCTGTTTCATCATTGTCTTCAGGAGAGCTTTCCAGAGTTGATCATTTCCTCTCATGGTACTCTGCTCAGCATGGC
CACGTAGGTTTTTTGTTTGTTTTGTTTTGTTCTTTTTTTGAGACGGAGTCTCACTCTGTTACCCAGGCTGGAATG
CAGTGGCGCAATCTTGGCTCACTTTAACCTCCACTTCCCTGGTTCAAGCAATTCCCCTGCCTTTGCCTCCCGAGT
AGCTGGGATTACAGGCACACACCACCACGCCCAGNTAGTTTTTTTGTATTTTTAGTAGAGACGGGGTTTCACCAT
GCAAGCCCAGCTGGCCACGTAGGTTTTAAAGCAAGGGGCGTGAAGAAGGCACAGTGAGGTATGTGGCTGTTCTCG
TGGTAGTTCATTCGGCCTAAATAGACCTGGCATTAAATTTCAAGAAGGATTTGGCATTTTCTCTTCTTGACCCTT
CTCTTTAAAGGGTAAAATATTAATGTTTAGAATGACAAAGATGAATTATTACAATAAATCTGATGTACACAGACT
GAAACATACACACATACACCCTAATCAAAACGTTGGGGAAAAATGTATTTGGTTTTGTTCCTTTCATCCTGTCTG
TGTTATGTGGGTGGAGATGGTTTTCATTCTTTCATTACTGTTTTGTTTTATCCTTTGTATCTGAAATACCTTTAA

FIGURE 311B

TTTATTTAATATCTGTTGTTCAGAGCTCTGCCATTTCTTGAGTACCTGTTAGTTAGTATTATTTATGTGTATCGG
GAGTGTGTTTAGTCTGTTTTATTTGCAGTAAACCGATCTCCAAAGATTTCCTTTTGGAAACGCTTTTTCCCCTCC
TTAATTTTTATATTCCTTACTGTTTTACTAAATATTAAGTGTTCTTTGACAATTTTGGTGCTCATGTGTTTTGGG
GACAAAAGTGAAATGAATCTGTCATTATACCAGAAAGTTAAATTCTCAGATCAAATGTGCCTTAATAAATTTGTT
TTCATTTAGATTTCAAACAGTGATAGACTTGCCATTTTAATACACGTCATTGGAGGGCTGCGTATTTGTAAATAG
CCTGATGCTCATTTGGAAAAATAAACCAGTGAACAATATTTTTCTATTGTACTTTTCGAACCATTTTGTCTCATT
ATTCCTGTTTTAGCTGAAGAATTGTATTACATTTGGAGAGTAAAAAACTTAAACACGAAAAAA

FIGURE 312

></usr/seqdb2/sst/DNA/Dnaseqs.min/ss.DNA68836
><subunit 1 of 1, 802 aa, 1 stop
><MW: 91812, pI: 9.52, NX(S/T): 3

```
MAARGRRAWLSVLLGLVLGFVLASRLVLPRASELKRAGPRRRASPEGCRSGQAAASQAGGARG
DARGAQLWPPGSDPDGGPRDRNFLFVGVMTAQKYLQTRAVAAYRTWSKTIPGKVQFFSSEGSD
TSVPIPVVPLRGVDDSYPPQKKSFMMLKYMHDHYLDKYEWFMRADDDVYIKGDRLENFLRSLN
SSEPLFLGQTGLGTTEEMGKLALEPGENFCMGGPGVIMSREVLRRMVPHIGKCLREMYTTHED
VEVGRCVRRFAGVQCVWSYEMRQLFYENYEQNKKGYIRDLHNSKIHQAITLHPNKNPPYQYRL
HSYMLSRKISELRHRTIQLHREIVLMSKYSNTEIHKEDLQLGIPPSFMRFQPRQREEILEWEF
LTGKYLYSAVDGQPPRRGMDSAQREALDDIVMQVMEMINANAKTRGRIIDFKEIQYGYRRVNP
MYGAEYILDLLLLYKKHKGKKMTVPVRRHAYLQQTFSKIQFVEHEELDAQELAKRINQESGSL
SFLSNSLKKLVPFQLPGSKSEHKEPKDKKINILIPLSGRFDMFVRFMGNFEKTCLIPNQNVKL
VVLLFNSDSNPDKAKQVELMRDYRIKYPKADMQILPVSGEFSRALALEVGSSQFNNESLLFFC
DVDLVFTTEFLQRCRANTVLGQQIYFPIIFSQYDPKIVYSGKVPSDNHFAFTQKTGFWRNYGF
GITCIYKGDLVRVGGFDVSIQGWGLEDVDLFNKVVQAGLKTFRSQEVGVVHVHHPVFCDPNLD
PKQYKMCLGSKASTYGSTQQLAEMWLEKNDPSYSKSSNNNGSVRTA
```

Signal peptide:
amino acids 1-23

FIGURE 313

GGCCGGACGCCTCCGCGTTACGGGATGAATTAACGGCGGGTTCCGCACGGAGGTTGTGACCCC
TACGGAGCCCCAGCTTGCCCACGCACCCCACTCGGCGTCGCGCGGCGTGCCCTGCTTGTCACA
GGTGGGAGGCTGGAACTATCAGGCTGAAAAACAGAGTGGGTACTCTCTTCTGGGAAGCTGGCA
ACAAATGGATGATGTGATATATGCATTCCAGGGGAAGGGAAATTGTGGTGCTTCTGAACCCAT
GGTCAATTAACGAGGCAGTTTCTAGCTACTGCACGTACTTCATAAAGCAGGACTCTAAAAGCT
TTGGAATCATGGTGTCATGGAAAGGGATTTACTTTATACTGACTCTGTTTTGGGGAAGCTTTT
TTGGAAGCATTTTCATGCTGAGTCCCTTTTTACCTTTGATGTTTGTAAACCCATCTTGGTATC
GCTGGATCAACAACCGCCTTGTGGCAACATGGCTCACCCTACCTGTGGCATTATTGGAGACCA
TGTTTGGTGTAAAAGTGATTATAACTGGGGATGCATTTGTTCCTGGAGAAAGAAGTGTCATTA
TCATGAACCATCGGACAAGAATGGACTGGATGTTCCTGTGGAATTGCCTGATGCGATATAGCT
ACCTCAGATTGGAGAAAATTTGCCTCAAAGCGAGTCTCAAAGGTGTTCCTGGATTTGGTTGGG
CCATGCAGGCTGCTGCCTATATCTTCATTCATAGGAAATGGAAGGATGACAAGAGCCATTTCG
AAGACATGATTGATTACTTTTGTGATATTCACGAACCACTTCAACTCCTCATATTCCCAGAAG
GGACTGATCTCACAGAAAACAGCAAGTCTCGAAGTAATGCATTTGCTGAAAAAAATGGACTTC
AGAAATATGAATATGTTTTACATCCAAGAACTACAGGCTTTACTTTTGTGGTAGACCGTCTAA
GAGAAGGTAAGAACCTTGATGCTGTCCATGATATCACTGTGGCGTATCCTCACAACATTCCTC
AATCAGAGAAGCACCTCCTCCAAGGAGACTTTCCCAGGGAAATCCACTTTCACGTCCACCGGT
ATCCAATAGACACCCTCCCCACATCCAAGGAGGACCTTCAACTCTGGTGCCACAAACGGTGGG
AAGAGAAAGAAGAGAGGCTGCGTTCCTTCTATCAAGGGGAGAAGAATTTTTATTTTACCGGAC
AGAGTGTCATTCCACCTTGCAAGTCTGAACTCAGGGTCCTTGTGGTCAAATTGCTCTCTATAC
TGTATTGGACCCTGTTCAGCCCTGCAATGTGCCTACTCATATATTTGTACAGTCTTGTTAAGT
GGTATTTTATAATCACCATTGTAATCTTTGTGCTGCAAGAGAGAATATTTGGTGGACTGGAGA
TCATAGAACTTGCATGTTACCGACTTTTACACAAACAGCCACATTTAAATTCAAAGAAAAATG
AGTAAGATTATAAGGTTTGCCATGTGAAAACCTAGAGCATATTTTGGAAATGTTCTAAACCTT
TCTAAGCTCAGATGCATTTTTGCATGACTATGTCGAATATTTCTTACTGCCATCATTATTTGT
TAAAGATATTTTGCACTTAATTTTGTGGGAAAAATATTGCTACAATTTTTTTAATCTCTGAA
TGTAATTTCGATACTGTGTACATAGCAGGGAGTGATCGGGGTGAAATAACTTGGGCCAGAATA
TTATTAAACAATCATCAGGCTTTTAAA

FIGURE 314

MHSRGREIVVLLNPWSINEAVSSYCTYFIKQDSKSFGIMVSWKGIYFILTLFWGSFFGSIFML
SPFLPLMFVNPSWYRWINNRLVATWLTLPVALLETMFGVKVIITGDAFVPGERSVIIMNHRTR
MDWMFLWNCLMRYSYLRLEKICLKASLKGVPGFGWAMQAAAYIFIHRKWKDDKSHFEDMIDYF
CDIHEPLQLLIFPEGTDLTENSKSRSNAFAEKNGLQKYEYVLHPRTTGFTFVVDRLREGKNLD
AVHDITVAYPHNIPQSEKHLLQGDFPREIHFHVHRYPIDTLPTSKEDLQLWCHKRWEEKEERL
RSFYQGEKNFYFTGQSVIPPCKSELRVLVVKLLSILYWTLFSPAMCLLIYLYSLVKWYFIITI
VIFVLQERIFGGLEIIELACYRLLHKQPHLNSKKNE

Important features of the protein:
Signal peptide:
amino acids 1-22

Transmembrane domains:
amino acids 44-63, 90-108, 354-377

FIGURE 315

CGGCTCGAGCGGCTCGAGTGAAGAGCCTCTCCACGGCTCCTGCGCCTGAGACAGCTGGCCTGA
CCTCCAAATCATCCATCCACCCCTGCTGTCATCTGTTTTCATAGTGTGAGATCAACCCACAGG
AATATCCATGGCTTTTGTGCTCATTTTGGTTCTCAGTTTCTACGAGCTGGTGTCAGGACAGTG
GCAAGTCACTGGACCGGGCAAGTTTGTCCAGGCCTTGGTGGGGGAGGACGCCGTGTTCTCCTG
CTCCCTCTTTCCTGAGACCAGTGCAGAGGCTATGGAAGTGCGGTTCTTCAGGAATCAGTTCCA
TGCTGTGGTCCACCTCTACAGAGATGGGGAAGACTGGGAATCTAAGCAGATGCCACAGTATCG
AGGGAGAACTGAGTTTGTGAAGGACTCCATTGCAGGGGGGCGTGTCTCTCTAAGGCTAAAAAA
CATCACTCCCTCGGACATCGGCCTGTATGGGTGCTGGTTCAGTTCCCAGATTTACGATGAGGA
GGCCACCTGGGAGCTGCGGGTGGCAGCACTGGGCTCACTTCCTCTCATTTCCATCGTGGGATA
TGTTGACGGAGGTATCCAGTTACTCTGCCTGTCCTCAGGCTGGTTCCCCCAGCCCACAGCCAA
GTGGAAAGGTCCACAAGGACAGGATTTGTCTTCAGACTCCAGAGCAAATGCAGATGGGTACAG
CCTGTATGATGTGGAGATCTCCATTATAGTCCAGGAAAATGCTGGGAGCATATTGTGTTCCAT
CCACCTTGCTGAGCAGAGTCATGAGGTGGAATCCAAGGTATTGATAGGAGAGACGTTTTTCCA
GCCCTCACCTTGGCGCCTGGCTTCTATTTTACTCGGGTTACTCTGTGGTGCCCTGTGTGGTGT
TGTCATGGGGATGATAATTGTTTTCTTCAAATCCAAAGGGAAAATCCAGGCGGAACTGGACTG
GAGAAGAAAGCACGGACAGGCAGAATTGAGAGACGCCCGGAAACACGCAGTGGAGGTGACTCT
GGATCCAGAGACGGCTCACCCGAAGCTCTGCGTTTCTGATCTGAAAACTGTAACCCATAGAAA
AGCTCCCCAGGAGGTGCCTCACTCTGAGAAGAGATTTACAAGGAAGAGTGTGGTGGCTTCTCA
GGGTTTCCAAGCAGGGAGACATTACTGGGAGGTGGACGTGGGACAAAATGTAGGGTGGTATGT
GGGAGTGTGTCGGGATGACGTAGACAGGGGGAAGAACAATGTGACTTTGTCTCCCAACAATGG
GTATTGGGTCCTCAGACTGACAACAGAACATTTGTATTTCACATTCAATCCCCATTTTATCAG
CCTCCCCCCCAGCACCCCTCCTACACGAGTAGGGGTCTTCCTGGACTATGAGGGTGGGACCAT
CTCCTTCTTCAATACAAATGACCAGTCCCTTATTTATACCCTGCTGACATGTCAGTTTGAAGG
CTTGTTGAGACCCTATATCCAGCATGCGATGTATGACGAGGAAAAGGGGACTCCCATATTCAT
ATGTCCAGTGTCCTGGGGATGAGACAGAGAAGACCCTGCTTAAAGGGCCCCACACCACAGACC
CAGACACAGCCAAGGGAGAGTGCTCCCGACAGGTGGCCCCAGCTTCCTCTCCGGAGCCTGCGC
ACAGAGAGTCACGCCCCCCACTCTCCTTTAGGGAGCTGAGGTTCTTCTGCCCTGAGCCCTGCA
GCAGCGGCAGTCACAGCTTCCAGATGAGGGGGGATTGGCCTGACCCTGTGGGAGTCAGAAGCC
ATGGCTGCCCTGAAGTGGGGACGGAATAGACTCACATTAGGTTTAGTTTGTGAAAACTCCATC
CAGCTAAGCGATCTTGAACAAGTCACAACCTCCCAGGCTCCTCATTTGCTAGTCACGGACAGT
GATTCCTGCCTCACAGGTGAAGATTAAAGAGACAACGAATGTGAATCATGCTTGCAGGTTTGA
GGGCACAGTGTTTGCTAATGATGTGTTTTTATATTATACATTTTCCCACCATAAACTCTGTTT
GCTTATTCCACATTAATTTACTTTTCTCTATACCAAATCACCCATGGAATAGTTATTGAACAC
CTGCTTTGTGAGGCTCAAAGAATAAAGAGGAGGTAGGATTTTTCACTGATTCTATAAGCCCAG
CATTACCTGATACCAAAACCAGGCAAAGAAAACAGAAGAAGAGGAAGGAAAACTACAGGTCCA
TATCCCTCATTAACACAGACACAAAAATTCTAAATAAAATTTTAACAAATTAAACTAAACAAT
ATATTTAAAGATGATATATAACTACTCAGTGTGGTTTGTCCCACAAATGCAGAGTTGGTTTAA
TATTTAAATATCAACCAGTGTAATTCAGCACATTAATAAAGTAAAAAAGAAAACCATAAAAAA
AAAAAAAAA

FIGURE 316

></usr/seqdb2/sst/DNA/Dnaseqs.min/ss.DNA68866
><subunit 1 of 1, 466 aa, 1 stop
><MW: 52279, pI: 6.16, NX(S/T): 2
MAFVLILVLSFYELVSGQWQVTGPGKFVQALVGEDAVFSCSLFPETSAEAMEVRFFRNQFHAV
VHLYRDGEDWESKQMPQYRGRTEFVKDSIAGGRVSLRLKNITPSDIGLYGCWFSSQIYDEEAT
WELRVAALGSLPLISIVGYVDGGIQLLCLSSGWFPQPTAKWKGPQGQDLSSDSRANADGYSLY
DVEISIIVQENAGSILCSIHLAEQSHEVESKVLIGETFFQPSPWRLASILLGLLCGALCGVVM
GMIIVFFKSKGKIQAELDWRRKHGQAELRDARKHAVEVTLDPETAHPKLCVSDLKTVTHRKAP
QEVPHSEKRFTRKSVVASQGFQAGRHYWEVDVGQNVGWYVGVCRDDVDRGKNNVTLSPNNGYW
VLRLTTEHLYFTFNPHFISLPPSTPPTRVGVFLDYEGGTISFFNTNDQSLIYTLLTCQFEGLL
RPYIQHAMYDEEKGTPIFICPVSWG

Signal peptide:
amino acids 1-17

Transmembrane domains:
amino acids 131-150, 235-259

FIGURE 317

GCACCTGCGACCACCGTGAGCAGTCATGGCGTACTCCACAGTGCAGAGAGTCGCTCTGGCTTC
TGGGCTTGTCCTGGCTCTGTCGCTGCTGCTGCCCAAGGCCTTCCTGTCCCGCGGGAAGCGGCA
GGAGCCGCCGCCGACACCTGAAGGAAAATTGGGCCGATTTCCACCTATGATGCATCATCACCA
GGCACCCTCAGATGGCCAGACTCCTGGGGCTCGTTTCCAGAGGTCTCACCTTGCCGAGGCATT
TGCAAAGGCCAAAGGATCAGGTGGAGGTGCTGGAGGAGGAGGTAGTGGAAGAGGTCTGATGGG
GCAGATTATTCCAATCTACGGTTTTGGGATTTTTTTATATATACTGTACATTCTATTTAAGGT
AAGTAGAATCATCCTAATCATATTACATCAATGAAAATCTAATATGGCGATAAAAATCATTGT
CTACATTAAAACTTCTTATAGTTCATAAAATTATTTCAAATCCATCATCTCTTTAAATCCTGC
CTCCTCTTCATGAGGTACTTAGGATAGCCATTATTTCAGTTTCACATAAGAATGTTTACTCAA
TGTTTAAGTGTTTTGCCCCAAAATTCACAACTAACAAGGCAGAACTAGGACTTGAACATGGAT
CTTTTGGTTCTTAATCCAGTGAGTGATACAATTCAATGCACTCCCCTGCCA

FIGURE 318

MAYSTVQRVALASGLVLALSLLLPKAFLSRGKRQEPPPTPEGKLGRFPPMMHHHQAPSDGQTP
GARFQRSHLAEAFAKAKGSGGGAGGGGSGRGLMGQIIPIYGFGIFLYILYILFKVSRIILIILHQ

FIGURE 319

CCTTCACAGGACTCTTCATTGCTGGTTGGCAATGATGTATCGGCCAGATGTGGTGAGGGCTAG
GAAAAGAGTTTGTTGGGAACCCTGGGTTATCGGCCTCGTCATCTTCATATCCCTGATTGTCCT
GGCAGTGTGCATTGGACTCACTGTTCATTATGTGAGATATAATCAAAAGAAGACCTACAATTA
CTATAGCACATTGTCATTTACAACTGACAAACTATATGCTGAGTTTGGCAGAGAGGCTTCTAA
CAATTTTACAGAAATGAGCCAGAGACTTGAATCAATGGTGAAAAATGCATTTTATAAATCTCC
ATTAAGGGAAGAATTTGTCAAGTCTCAGGTTATCAAGTTCAGTCAACAGAAGCATGGAGTGTT
GGCTCATATGCTGTTGATTTGTAGATTTCACTCTACTGAGGATCCTGAAACTGTAGATAAAAT
TGTTCAACTTGTTTTACATGAAAAGCTGCAAGATGCTGTAGGACCCCCTAAAGTAGATCCTCA
CTCAGTTAAAATTAAAAAAATCAACAAGACAGAAACAGACAGCTATCTAAACCATTGCTGCGG
AACACGAAGAAGTAAAACTCTAGGTCAGAGTCTCAGGATCGTTGGTGGGACAGAAGTAGAAGA
GGGTGAATGGCCCTGGCAGGCTAGCCTGCAGTGGGATGGGAGTCATCGCTGTGGAGCAACCTT
AATTAATGCCACATGGCTTGTGAGTGCTGCTCACTGTTTTACAACATATAAGAACCCTGCCAG
ATGGACTGCTTCCTTTGGAGTAACAATAAAACCTTCGAAAATGAAACGGGGTCTCCGGAGAAT
AATTGTCCATGAAAAATACAAACACCCATCACATGACTATGATATTTCTCTTGCAGAGCTTTC
TAGCCCTGTTCCCTACACAAATGCAGTACATAGAGTTTGTCTCCCTGATGCATCCTATGAGTT
TCAACCAGGTGATGTGATGTTTGTGACAGGATTTGGAGCACTGAAAAATGATGGTTACAGTCA
AAATCATCTTCGACAAGCACAGGTGACTCTCATAGACGCTACAACTTGCAATGAACCTCAAGC
TTACAATGACGCCATAACTCCTAGAATGTTATGTGCTGGCTCCTTAGAAGGAAAAACAGATGC
ATGCCAGGGTGACTCTGGAGGACCACTGGTTAGTTCAGATGCTAGAGATATCTGGTACCTTGC
TGGAATAGTGAGCTGGGGAGATGAATGTGCGAAACCCAACAAGCCTGGTGTTTATACTAGAGT
TACGGCCTTGCGGGACTGGATTACTTCAAAAACTGGTATCTAAGAGACAAAAGCCTCATGGAA
CAGATAACATTTTTTTTTGTTTTTTGGGTGTGGAGGCCATTTTTAGAGATACAGAATTGGAGA
AGACTTGCAAAACAGCTAGATTTGACTGATCTCAATAAACTGTTTGCTTGATGCATGTATTTT
CTTCCCAGCTCTGTTCCGCACGTAAGCATCCTGCTTCTGCCAGATCAACTCTGTCATCTGTGA
GCAATAGTTGAAACTTTATGTACATAGAGAAATAGATAATACAATATTACATTACAGCCTGTA
TTCATTTGTTCTCTAGAAGTTTTGTCAGAATTTTGACTTGTTGACATAAATTTGTAATGCATA
TATACAATTTGAAGCACTCCTTTTCTTCAGTTCCTCAGCTCCTCTCATTTCAGCAAATATCCA
TTTTCAAGGTGCAGAACAAGGAGTGAAAGAAAATATAAGAAGAAAAAAATCCCCTACATTTTA
TTGGCACAGAAAAGTATTAGGTGTTTTTCTTAGTGGAATATTAGAAATGATCATATTCATTAT
GAAAGGTCAAGCAAAGACAGCAGAATACCAATCACTTCATCATTTAGGAAGTATGGGAACTAA
GTTAAGGAAGTCCAGAAAGAAGCCAAGATATATCCTTATTTTCATTTCCAAACAACTACTATG
ATAAATGTGAAGAAGATTCTGTTTTTTTGTGACCTATAATAATTATACAAACTTCATGCAATG
TACTTGTTCTAAGCAAATTAAAGCAAATATTTATTTAACATTGTTACTGAGGATGTCAACATA
TAACAATAAAATATAAATCACCCA

FIGURE 320

></usr/seqdb2/sst/DNA/Dnaseqs.min/ss.DNA68871

><subunit 1 of 1, 423 aa, 1 stop

><MW: 47696, pI: 8.96, NX(S/T): 3

MMYRPDVVRARKRVCWEPWVIGLVIFISLIVLAVCIGLTVHYVRYNQKKTYNYYSTLSFTTDK
LYAEFGREASNNFTEMSQRLESMVKNAFYKSPLREEFVKSQVIKFSQQKHGVLAHMLLICRFH
STEDPETVDKIVQLVLHEKLQDAVGPPKVDPHSVKIKKINKTETDSYLNHCCGTRRSKTLGQS
LRIVGGTEVEEGEWPWQASLQWDGSHRCGATLINATWLVSAAHCFTTYKNPARWTASFGVTIK
PSKMKRGLRRIIVHEKYKHPSHDYDISLAELSSPVPYTNAVHRVCLPDASYEFQPGDVMFVTG
FGALKNDGYSQNHLRQAQVTLIDATTCNEPQAYNDAITPRMLCAGSLEGKTDACQGDSGGPLV
SSDARDIWYLAGIVSWGDECAKPNKPGVYTRVTALRDWITSKTGI

Transmembrane domain:

amino acids 21-40 (type II)

FIGURE 321

CCGGGCTCCTGGGTGAGGCCGGCAAGTTTGGAGCGTGGTCAGACAATAGGGGCGTGGCTACGG
CTCGCGGAGCGCAACCAACGCTCTAGACCAGACCTGGGCTCGAGACCATAACTGTTTGGCTTT
AACAGTACGTGGGCGGCCGGAATCCGGGAGTCCGGTGACCCGGGCTGTGGTCTAGCATAAAGG
CGGAGCCCAGAAGAAGGGGCGGGGTATGGGAGAAGCCTCCCCACCTGCCCCCGCAAGGCGGCA
TCTGCTGGTCCTGCTGCTGCTCCTCTCTACCCTGGTGATCCCCTCCGCTGCAGCTCCTATCCA
TGATGCTGACGCCCAAGAGAGCTCCTTGGGTCTCACAGGCCTCCAGAGCCTACTCCAAGGCTT
CAGCCGACTTTTCCTGAAAGGTAACCTGCTTCGGGGCATAGACAGCTTATTCTCTGCCCCCAT
GGACTTCCGGGGCCTCCCTGGGAACTACCACAAAGAGGAGAACCAGGAGCACCAGCTGGGGAA
CAACACCCTCTCCAGCCACCTCCAGATCGACAAGATGACCGACAACAAGACAGGAGAGGTGCT
GATCTCCGAGAATGTGGTGGCATCCATTCAACCAGCGGAGGGGAGCTTCGAGGGTGATTTGAA
GGTACCCAGGATGGAGGAGAAGGAGGCCCTGGTACCCATCCAGAAGGCCACGGACAGCTTCCAC
ACAGAACTCCATCCCCGGGTGGCCTTCTGGATCATTAAGCTGCCACGGCGGAGGTCCCACCAG
GATGCCCTGGAGGGCGGCCACTGGCTCAGCGAGAAGCGACACCGCCTGCAGGCCATCCGGGAT
GGACTCCGCAAGGGGACCCACAAGGACGTCCTAGAAGAGGGGACCGAGAGCTCCTCCCACTCC
AGGCTGTCCCCCCGAAAGACCCACTTACTGTACATCCTCAGGCCCTCTCGGCAGCTGTAGGGG
TGGGGACCGGGGAGCACCTGCCTGTAGCCCCCATCAGACCCTGCCCCAAGCACCATATGGAAA
TAAAGTTCTTTCTTACATCTAAAAA

FIGURE 322

></usr/seqdb2/sst/DNA/Dnaseqs.min/ss.DNA68879
><subunit 1 of 1, 242 aa, 1 stop
><MW: 27007, pI: 8.68, NX(S/T): 2
MGEASPPAPARRHLLVLLLLLSTLVIPSAAAPIHDADAQESSLGLTGLQSLLQGFSRLFL
KGNLLRGIDSLFSAPMDFRGLPGNYHKEENQEHQLGNNTLSSHLQIDKMTDNKTGEVLIS
ENVVASIQPAEGSFEGDLKVPRMEEKEALVPIQKATDSFHTELHPRVAFWIIKLPRRRSH
QDALEGGHWLSEKRHRLQAIRDGLRKGTHKDVLEEGTESSSHSRLSPRKTHLLYILRPSR
QL

Important features of the protein:

Signal peptide:

Amino acids 1-30

N-glycosylation sites:

Amino acids 97-101;112-116

N-myristoylation sites:

Amino acids 80-86;132-138;203-209;216-222

FIGURE 323

AGAGAAAGAAGCGTCTCCAGCTGAAGCCAATGCAGCCCTCCGGCTCTCCGCGAAGAAGTTCCC
TGCCCCGATGAGCCCCCGCCGTGCGTCCCCGACTATCCCCAGGCGGCGTGGGGCACCGGGCC
CAGCGCCGACGATCGCTGCCGTTTTGCCCTTGGGAGTAGGATGTGGTGAAAGGATGGGGCTTC
TCCCTTACGGGGCTCACAATGGCCAGAGAAGATTCCGTGAAGTGTCTGCGCTGCCTGCTCTAC
GCCCTCAATCTGCTCTTTTGGTTAATGTCCATCAGTGTGTTGGCAGTTTCTGCTTGGATGAGG
GACTACCTAAATAATGTTCTCACTTTAACTGCAGAAACGAGGGTAGAGGAAGCAGTCATTTTG
ACTTACTTTCCTGTGGTTCATCCGGTCATGATTGCTGTTTGCTGTTTCCTTATCATTGTGGGG
ATGTTAGGATATTGTGGAACGGTGAAAAGAAATCTGTTGCTTCTTGCATGGTACTTTGGAAGT
TTGCTTGTCATTTTCTGTGTAGAACTGGCTTGTGGCGTTTGGACATATGAACAGGAACTTATG
GTTCCAGTACAATGGTCAGATATGGTCACTTTGAAAGCCAGGATGACAAATTATGGATTACCT
AGATATCGGTGGCTTACTCATGCTTGGAATTTTTTTCAGAGAGAGTTTAAGTGCTGTGGAGTA
GTATATTTCACTGACTGGTTGGAAATGACAGAGATGGACTGGCCCCCAGATTCCTGCTGTGTT
AGAGAATTCCCAGGATGTTCCAAACAGGCCCACCAGGAAGATCTCAGTGACCTTTATCAAGAG
GGTTGTGGGAAGAAAATGTATTCCTTTTTGAGAGGAACCAAACAACTGCAGGTGCTGAGGTTT
CTGGGAATCTCCATTGGGGTGACACAAATCCTGGCCATGATTCTCACCATTACTCTGCTCTGG
GCTCTGTATTATGATAGAAGGGAGCCTGGGACAGACCAAATGATGTCCTTGAAGAATGACAAC
TCTCAGCACCTGTCATGTCCCTCAGTAGAACTGTTGAAACCAAGCCTGTCAAGAATCTTTGAA
CACACATCCATGGCAAACAGCTTTAATACACACTTTGAGATGGAGGAGTTATAAAAAGAAATG
TCACAGAAGAAAACCACAAACTTGTTTTATTGGACTTGTGAATTTTTGAGTACATACTATGTG
TTTCAGAAATATGTAGAAATAAAAATGTTGCCATAAAATAACACCTAAGCATATACTATTCTA
TGCTTTAAAATGAGGATGGAAAAGTTTCATGTCATAAGTCACCACCTGGACAATAATTGATGC
CCTTAAAATGCTGAAGACAGATGTCATACCCACTGTGTAGCCTGTGTATGACTTTTACTGAAC
ACAGTTATGTTTTGAGGCAGCATGGTTTGATTAGCATTTCCGCATCCATGCAAACGAGTCACA
TATGGTGGGACTGGAGCCATAGTAAAGGTTGATTTACTTCTACCAACTAGTATATAAAGTACT
AATTAAATGCTAACATAGGAAGTTAGAAAATACTAATAACTTTTATTACTCAGCGATCTATTC
TTCTGATGCTAAATAAATTATATATCAGAAAACTTTCAATATTGGTGACTACCTAAATGTGAT
TTTTGCTGGTTACTAAAATATTCTTACCACTTAAAAGAGCAAGCTAACACATTGTCTTAAGCT
GATCAGGGATTTTTTGTATATAAGTCTGTGTTAAATCTGTATAATTCAGTCGATTTCAGTTCT
GATAATGTTAAGAATAACCATTATGAAAAGGAAAATTTGTCCTGTATAGCATCATTATTTTA
GCCTTTCCTGTTAATAAAGCTTTACTATTCTGTCCTGGGCTTATATTACACATATAACTGTTA
TTTAAATACTTAACCACTAATTTTGAAAATTACCAGTGTGATACATAGGAATCATTATTCAGA
ATGTAGTCTGGTCTTTAGGAAGTATTAATAAGAAAATTTGCACATAACTTAGTTGATTCAGAA
AGGACTTGTATGCTGTTTTTCTCCCAAATGAAGACTCTTTTTGACACTAAACACTTTTTAAAA
AGCTTATCTTTGCCTTCTCCAAACAAGAAGCAATAGTCTCCAAGTCAATATAAATTCTACAGA
AAATAGTGTTCTTTTTCTCCAGAAAAATGCTTGTGAGAATCATTAAAACATGTGACAATTTAG
AGATTCTTTGTTTTATTTCACTGATTAATATACTGTGGCAAATTACACAGATTATTAAATTTT
TTTACAAGAGTATAGTATATTTATTTGAAATGGGAAAAGTGCATTTTACTGTATTTTGTGTAT
TTTGTTTATTTCTCAGAATATGGAAAGAAAATTAAAATGTGTCAATAAATATTTTCTAGAGAG
TAA

FIGURE 324

></usr/seqdb2/sst/DNA/Dnaseqs.min/ss.DNA68880

><subunit 1 of 1, 305 aa, 1 stop

><MW: 35383, pI: 5.99, NX(S/T): 0

MAREDSVKCLRCLLYALNLLFWLMSISVLAVSAWMRDYLNNVLTLTAETRVEEAVILTYFPVV
HPVMIAVCCFLIIVGMLGYCGTVKRNLLLLAWYFGSLLVIFCVELACGVWTYEQELMVPVQWS
DMVTLKARMTNYGLPRYRWLTHAWNFFQREFKCCGVVYFTDWLEMTEMDWPPDSCCVREFPGC
SKQAHQEDLSDLYQEGCGKKMYSFLRGTKQLQVLRFLGISIGVTQILAMILTITLLWALYYDR
REPGTDQMMSLKNDNSQHLSCPSVELLKPSLSRIFEHTSMANSFNTHFEMEEL

Signal peptide:

amino acids 1-33

Transmembrane domains:

amino acids 12-35, 57-86, 94-114, 226-248

FIGURE 325

AGCAGTGCATTGCTGGAGCGAGGAGAAGCTCACGAATCAGCTGCAGGTCTCTGTTTTGAAAAA
GCAGAGATACAGAGGCAGAGGAAAAGGGTGGACTCCTATGTGACCTGTTCTTAGAGCAAGACA
ATCACCATCTGAATTCCAGAAGCCCTGTTCATGGTTGGGGATATTTTCTCGACTGCATGGAAT
CAGAAAGAAGCAAAAGGATGGGAAATGCCTGCATTCCCCTGAAAAGAATTGCTTATTTCCTAT
GTCTCTTATCTGCGCTTTTGCTGACTGAGGGGAAGAAACCAGCGAAGCCAAAATGCCCTGCCG
TGTGTACTTGTACCAAAGATAATGCTTTATGTGAGAATGCCAGATCCATTCCACGCACCGTTC
CTCCTGATGTTATCTCATTATCCTTTGTGAGATCTGGTTTTACTGAAATCTCAGAAGGGAGTT
TTTTATTCACGCCATCGCTGCAGCTCTTGTTATTCACATCGAACTCCTTTGATGTGATCAGTG
ATGATGCTTTTATTGGTCTTCCACATCTAGAGTATTTATTCATAGAAAACAACAACATCAAGT
CAATTTCAAGACATACTTTCCGGGGACTAAAGTCATTAATTCACTTGAGCCTTGCAAACAACA
ATCTCCAGACACTCCCAAAAGATATTTTCAAAGGCCTGGATTCTTTAACAAATGTGGACCTGA
GGGGTAATTCATTTAATTGTGACTGTAAACTGAAATGGCTAGTGGAATGGCTTGGCCACACCA
ATGCAACTGTTGAAGACATCTACTGCGAAGGCCCCCCAGAATACAAGAAGCGCAAAATCAATA
GTCTCTCCTCGAAGGATTTCGATTGCATCATTACAGAATTTGCAAAGTCTCAAGACCTGCCTT
ATCAATCATTGTCCATAGACACTTTTTCTTATTTGAATGATGAGTATGTAGTCATCGCTCAGC
CTTTTACTGGAAAATGCATTTTCCTTGAATGGGACCATGTGGAAAAGACCTTCCGGAATTATG
ACAACATTACAGGCACATCCACTGTAGTATGCAAGCCTATAGTCATTGAAACTCAGCTCTATG
TTATTGTGGCCCAGCTGTTTGGTGGCTCTCACATCTATAAGCGAGACAGTTTTGCAAATAAAT
TCATAAAAATCCAGGATATTGAAATTCTCAAAATCCGAAAACCCAATGACATTGAAACATTCA
AGATTGAAAACAACTGGTACTTTGTTGTTGCTGACAGTTCAAAAGCTGGTTTTACTACCATTTAC
AAATGGAACGGAAACGGATTCTACTCCCATCAATCCTTACACGCGTGGTACAGGGACACTGAT
GTGGAATATCTAGAAATAGTCAGAACACCTCAGACACTCAGAACGCCTCATTTAATTCTGTCT
AGTAGTTCCCAGCGTCCTGTAATTTATCAGTGGAACAAAGCAACACAATTATTCACTAACCAA
ACTGACATTCCTAACATGGAGGATGTGTACGCAGTGAAGCACTTCTCAGTGAAAGGGGACGTG
TACATTTGCTTGACAAGATTCATTGGTGATTCCAAAGTCATGAAATGGGGAGGCTCCTCGTTC
CAGGATATTCAGAGGATGCCATCGCGAGGATCCATGGTGTTCCAGCCTCTTCAAATAAATAAT
TACCAATATGCAATTCTTGGAAGTGATTACTCCTTTACTCAAGTGTATAACTGGGATGCAGAG
AAAGCCAAATTTGTGAAATTTCAGGAATTAAATGTTCAGGCACCAAGATCATTCACACATGTG
TCCATTAATAAGCGTAATTTTCTTTTTGCTTCCAGTTTTAAGGGAAATACACAGATTTACAAA
CATGTCATAGTTGACTTAAGCGCATGAGACACCAAATTCTGTGGCTGCCATCAGAAATTTTCT
ACAGTACATGACCCGGATGAACTCAATGCATGATGACTCTTCTTATCACACTTGCAAATGAAT
GCCTTTCAAACATTGAGACTGCTAGAACCAAGCACTACCAGTATCTCCATCCTTAACTGTCCA
GTCCAGTGATGTGGGAAGTTACCTTTTATAAGACAAAATTTAATTGTGTAACTGTTCTTTGCA
GTGAAGATGTGTAAATAAGCGTTTAATGGTATCTGTTACTCCAAAAAGAAATATTAATATGTA
CTTTTCCATTTATTTATTCATGTGTACAGAAACAACTGCCAAATAAAATGTTTACATTTTCTT
TCATA

FIGURE 326

></usr/seqdb2/sst/DNA/Dnaseqs.min/ss.DNA68882
><subunit 1 of 1, 557 aa, 1 stop
><MW: 63818, pI: 8.61, NX(S/T): 3
MESERSKRMGNACIPLKRIAYFLCLLSALLLTEGKKPAKPKCPAVCTCTKDNALCENARS
IPRTVPPDVISLSFVRSGFTEISEGSFLFTPSLQLLLFTSNSFDVISDDAFIGLPHLEYL
FIENNNIKSISRHTFRGLKSLIHLSLANNNLQTLPKDIFKGLDSLTNVDLRGNSFNCDCK
LKWLVEWLGHTNATVEDIYCEGPPEYKKRKINSLSSKDFDCIITEFAKSQDLPYQSLSID
TFSYLNDEYVVIAQPFTGKCIFLEWDHVEKTFRNYDNITGTSTVVCKPIVIETQLYVIVA
QLFGGSHIYKRDSFANKFIKIQDIEILKIRKPNDIETFKIENNWYFVVADSSKAGFTTIY
KWNGNGFYSHQSLHAWYRDTDVEYLEIVRTPQTLRTPHLILSSSSQRPVIYQWNKATQLF
TNQTDIPNMEDVYAVKHFSVKGDVYICLTRFIGDSKVMKWGGSSFQDIQRMPSRGSMVFQ
PLQINNYQYAILGSDYSFTQVYNWDAEKAKFVKFQELNVQAPRSFTHVSINKRNFLFASS
FKGNTQIYKHVIVDLSA

Important features of the protein:
Signal peptide:
Amino acids 1-34

Transmembrane domain:
Amino acids 281-306

N-glycosylation sites:
Amino acids 192-196;277-281;422-426 cAMP- and cGMP-dependent protein kinase phosphorylation site:
Amino acids 310-314

Tyrosine kinase phosphorylation sites:
Amino acids 228-235;378-385

N-myristoylation sites:
Amino acids 172-178;493-499

Amidation site:
Amino acids 33-37

FIGURE 327

CCAAGGCCAGAGCTGTGGACACCTTATCCCACTCATCCTCATCCTCTTCCTCTGATAAAGCCC
CTACCAGTGCTGATAAAGTCTTTCTCGTGAGAGCCTAGAGGCCTTAAAAAAAAAAGTGCTTGA
AAGAGAAGGGGACAAAGGAACACCAGTATTAAGAGGATTTTCCAGTGTTTCTGGCAGTTGGTC
CAGAAGGATGCCTCCATTCCTGCTTCTCACCTGCCTCTTCATCACAGGCACCTCCGTGTCACC
CGTGGCCCTAGATCCTTGTTCTGCTTACATCAGCCTGAATGAGCCCTGGAGGAACACTGACCA
CCAGTTGGATGAGTCTCAAGGTCCTCCTCTATGTGACAACCATGTGAATGGGGAGTGGTACCA
CTTCACGGGCATGGCGGGAGATGCCATGCCTACCTTCTGCATACCAGAAAACCACTGTGGAAC
CCACGCACCTGTCTGGCTCAATGGCAGCCACCCCCTAGAAGGCGACGGCATTGTGCAACGCCA
GGCTTGTGCCAGCTTCAATGGGAACTGCTGTCTCTGGAACACCACGGTGGAAGTCAAGGCTTG
CCCTGGAGGCTACTATGTGTATCGTCTGACCAAGCCCAGCGTCTGCTTCCACGTCTACTGTGG
TCATTTTTATGACATCTGCGACGAGGACTGCCATGGCAGCTGCTCAGATACCAGCGAGTGCAC
ATGCGCTCCAGGAACTGTGCTAGGCCCTGACAGGCAGACATGCTTTGATGAAAATGAATGTGA
GCAAAACAACGGTGGCTGCAGTGAGATCTGTGTGAACCTCAAAAACTCCTACCGCTGTGAGTG
TGGGGTTGGCCGTGTGCTAAGAAGTGATGGCAAGACTTGTGAAGACGTTGAAGGATGCCACAA
TAACAATGGTGGCTGCAGCCACTCTTGCCTTGGATCTGAGAAAGGCTACCAGTGTGAATGTCC
CCGGGGCCTGGTGCTGTCTGAGGATAACCACACTTGCCAAGTCCCTGTGTTGTGCAAATCAAA
TGCCATTGAAGTGAACATCCCCAGGGAGCTGGTTGGTGGCCTGGAGCTCTTCCTGACCAACAC
CTCCTGCCGAGGAGTGTCCAACGGCACCCATGTCAACATCCTCTTCTCTCTCAAGACATGTGG
TACAGTGGTCGATGTGGTGAATGACAAGATTGTGGCCAGCAACCTCGTGACAGGTCTACCCAA
GCAGACCCCGGGGAGCAGCGGGGACTTCATCATCCGAACCAGCAAGCTGCTGATCCCGGTGAC
CTGCGAGTTTCCACGCCTGTACACCATTTCTGAAGGATACGTTCCCAACCTTCGAAACTCCCC
ACTGGAAATCATGAGCCGAAATCATGGGATCTTCCCATTCACTCTGGAGATCTTCAAGGACAA
TGAGTTTGAAGAGCCTTACCGGGAAGCTCTGCCCACCCTCAAGCTTCGTGACTCCCTCTACTT
TGGCATTGAGCCCGTGGTGCACGTGAGCGGCTTGGAAAGCTTGGTGGAGAGCTGCTTTGCCAC
CCCCACCTCCAAGATCGACGAGGTCCTGAAATACTACCTCATCCGGGATGGCTGTGTTTCAGA
TGACTCGGTAAAGCAGTACACATCCCGGGATCACCTAGCAAAGCACTTCCAGGTCCCTGTCTT
CAAGTTTGTGGGCAAAGACCACAAGGAAGTGTTTCTGCACTGCCGGGTTCTTGTCTGTGGAGT
GTTGGACGAGCGTTCCCGCTGTGCCCAGGGTTGCCACCGGCGAATGCGTCGTGGGGCAGGAGG
AGAGGACTCAGCCGGTCTACAGGGCCAGACGCTAACAGGCGGCCCGATCCGCATCGACTGGGA
GGACTAGTTCGTAGCCATACCTCGAGTCCCTGCATTGGACGGCTCTGCTCTTTGGAGCTTCTC
CCCCCACCGCCCTCTAAGAACATCTGCCAACAGCTGGGTTCAGACTTCACACTGTGAGTTCAG
ACTCCCAGCACCAACTCACTCTGATTCTGGTCCATTCAGTGGGCACAGGTCACAGCACTGCTG
AACAATGTGGCCTGGGTGGGGTTTCATCTTTCTAGGGTTGAAAACTAAACTGTCCACCCAGAA
AGACACTCACCCCATTTCCCTCATTTCTTTCCTACACTTAAATACCTCGTGTATGGTGCAATC
AGACCACAAAATCAGAAGCTGGGTATAATATTTCAAGTTACAAACCCTAGAAAAATTAAACAG
TTACTGAAATTATGACTTAAATACCCAATGACTCCTTAAATATGTAAATTATAGTTATACCTT
GAAATTTCAATTCAAATGCAGACTAATTATAGGGAATTTGGAAGTGTATCAATAAAACAGTAT
ATAATTTT

FIGURE 328

MPPFLLLTCLFITGTSVSPVALDPCSAYISLNEPWRNTDHQLDESQGPPLCDNHVNGEWYHFT
GMAGDAMPTFCIPENHCGTHAPVWLNGSHPLEGDGIVQRQACASFNGNCCLWNTTVEVKACPG
GYYVYRLTKPSVCFHVYCGHFYDICDEDCHGSCSDTSECTCAPGTVLGPDRQTCFDENECEQN
NGGCSEICVNLKNSYRCECGVGRVLRSDGKTCEDVEGCHNNNGGCSHSCLGSEKGYQCECPRG
LVLSEDNHTCQVPVLCKSNAIEVNIPRELVGGLELFLTNTSCRGVSNGTHVNILFSLKTCGTV
VDVVNDKIVASNLVTGLPKQTPGSSGDFIIRTSKLLIPVTCEFPRLYTISEGYVPNLRNSPLE
IMSRNHGIFPFTLEIFKDNEFEEPYREALPTLKLRDSLYFGIEPVVHVSGLESLVESCFATPT
SKIDEVLKYYLIRDGCVSDDSVKQYTSRDHLAKHFQVPVFKFVGKDHKEVFLHCRVLVCGVLD
ERSRCAQGCHRRMRRGAGGEDSAGLQGQTLTGGPIRIDWED

Important features of the protein:
Signal peptide:
amino acids 1-16

N-glycosylation sites.
amino acids 89-93, 116-120, 259-263, 291-295, 299-303

Tyrosine kinase phosphorylation sites.
amino acids 411-418, 443-451

N-myristoylation sites.
amino acids 226-232, 233-239, 240-246, 252-258, 296-302, 300-306, 522-528, 531-537

Aspartic acid and asparagine hydroxylation site.
amino acids 197-209

ZP domain proteins.
amino acids 431-457

Calcium-binding EGF-like proteins.
amino acids 191-212, 232-253

FIGURE 329

GAGAGAGGCAGCAGCTTGCTCAGCGGACAAGGATGCTGGGCGTGAGGGACCAAGGCCTGCCCT
GCACTCGGGCCTCCTCCAGCCAGTGCTGACCAGGGACTTCTGACCTGCTGGCCAGCCAGGACC
TGTGTGGGGAGGCCCTCCTGCTGCCTTGGGGTGACAATCTCAGCTCCAGGCTACAGGGAGACC
GGGAGGATCACAGAGCCAGCATGTTACAGGATCCTGACAGTGATCAACCTCTGAACAGCCTCG
ATGTCAAACCCCTGCGCAAACCCCGTATCCCCATGGAGACCTTCAGAAAGGTGGGGATCCCCA
TCATCATAGCACTACTGAGCCTGGCGAGTATCATCATTGTGGTTGTCCTCATCAAGGTGATTC
TGGATAAATACTACTTCCTCTGCGGGCAGCCTCTCCACTTCATCCCGAGGAAGCAGCTGTGTG
ACGGAGAGCTGGACTGTCCCTTGGGGGAGGACGAGGAGCACTGTGTCAAGAGCTTCCCCGAAG
GGCCTGCAGTGGCAGTCCGCCTCTCCAAGGACCGATCCACACTGCAGGTGCTGGACTCGGCCA
CAGGGAACTGGTTCTCTGCCTGTTTCGACAACTTCACAGAAGCTCTCGCTGAGACAGCCTGTA
GGCAGATGGGCTACAGCAGAGCTGTGGAGATTGGCCCAGACCAGGATCTGGATGTTGTTGAAA
TCACAGAAAACAGCCAGGAGCTTCGCATGCGGAACTCAAGTGGGCCCTGTCTCTCAGGCTCCC
TGGTCTCCCTGCACTGTCTTGCCTGTGGGAAGAGCCTGAAGACCCCCCGTGTGGTGGGTGGGG
AGGAGGCCTCTGTGGATTCTTGGCCTTGGCAGGTCAGCATCCAGTACGACAAACAGCACGTCT
GTGGAGGGAGCATCCTGGACCCCCACTGGGTCCTCACGGCAGCCCACTGCTTCAGGAAACATA
CCGATGTGTTCAACTGGAAGGTGCGGGCAGGCTCAGACAAACTGGGCAGCTTCCCATCCCTGG
CTGTGGCCAAGATCATCATCATTGAATTCAACCCCATGTACCCCAAAGACAATGACATCGCCC
TCATGAAGCTGCAGTTCCCACTCACTTTCTCAGGCACAGTCAGGCCCATCTGTCTGCCCTTCT
TTGATGAGGAGCTCACTCCAGCCACCCCACTCTGGATCATTGGATGGGGCTTTACGAAGCAGA
ATGGAGGGAAGATGTCTGACATACTGCTGCAGGCGTCAGTCCAGGTCATTGACAGCACACGGT
GCAATGCAGACGATGCGTACCAGGGGGAAGTCACCGAGAAGATGATGTGTGCAGGCATCCCGG
AAGGGGGTGTGGACACCTGCCAGGGTGACAGTGGTGGGCCCCTGATGTACCAATCTGACCAGT
GGCATGTGGTGGGCATCGTTAGCTGGGGCTATGGCTGCGGGGGCCCGAGCACCCCAGGAGTAT
ACACCAAGGTCTCAGCCTATCTCAACTGGATCTACAATGTCTGGAAGGCTGAGCTGTAATGCT
GCTGCCCCTTTGCAGTGCTGGGAGCCGCTTCCTTCCTGCCCTGCCCACCTGGGGATCCCCCAA
AGTCAGACACAGAGCAAGAGTCCCCTTGGGTACACCCCTCTGCCCACAGCCTCAGCATTTCTT
GGAGCAGCAAAGGGCCTCAATTCCTGTAAGAGACCCTCGCAGCCCAGAGGCGCCCAGAGGAAG
TCAGCAGCCCTAGCTCGGCCACACTTGGTGCTCCCAGCATCCCAGGGAGAGACACAGCCCACT
GAACAAGGTCTCAGGGGTATTGCTAAGCCAAGAAGGAACTTTCCCACACTACTGAATGGAAGC
AGGCTGTCTTGTAAAAGCCCAGATCACTGTGGGCTGGAGAGGAGAAGGAAAGGGTCTGCGCCA
GCCCTGTCCGTCTTCACCCATCCCCAAGCCTACTAGAGCAAGAAACCAGTTGTAATATAAAAT
GCACTGCCCTACTGTTGGTATGACTACCGTTACCTACTGTTGTCATTGTTATTACAGCTATGG
CCACTATTATTAAAGAGCTGTGTAACATCTCTGGCAAAAAAAAAAAA

FIGURE 330

></usr/seqdb2/sst/DNA/Dnaseqs.min/ss.DNA68885
><subunit 1 of 1, 432 aa, 1 stop
><MW: 47644, pI: 5.18, NX(S/T): 2
MLQDPDSDQPLNSLDVKPLRKPRIPMETFRKVGIPIIIALLSLASIIIVVVLIKVILDKYYFL
CGQPLHFIPRKQLCDGELDCPLGEDEEHCVKSFPEGPAVAVRLSKDRSTLQVLDSATGNWFSA
CFDNFTEALAETACRQMGYSRAVEIGPDQDLDVVEITENSQELRMRNSSGPCLSGSLVSLHCL
ACGKSLKTPRVVGGEEASVDSWPWQVSIQYDKQHVCGGSILDPHWVLTAAHCFRKHTDVFNWK
VRAGSDKLGSFPSLAVAKIIIIEFNPMYPKDNDIALMKLQFPLTFSGTVRPICLPFFDEELTP
ATPLWIIGWGFTKQNGGKMSDILLQASVQVIDSTRCNADDAYQGEVTEKMMCAGIPEGGVDTC
QGDSGGPLMYQSDQWHVVGIVSWGYGCGGPSTPGVYTKVSAYLNWIYNVWKAEL

Transmembrane domain:
amino acids 32-53 (typeII)

FIGURE 331

AGTGGTTCGATGGGAAGGATCTTTCTCCAAGTGGTTCCTCTTGAGGGGAGCATTTCTGCTGGC
TCCAGGACTTTGGCCATCTATAAAGCTTGGCAATGAGAAATAAGAAAATTCTCAAGGAGGACG
AGCTCTTGAGTGAGACCCAACAAGCTGCTTTTCACCAAATTGCAATGGAGCCTTTCGAAATCA
ATGTTCCAAAGCCCAAGAGGAGAAATGGGGTGAACTTCTCCCTAGCTGTGGTGGTCATCTACC
TGATCCTGCTCACCGCTGGCGCTGGGCTGCTGGTGGTCCAAGTTCTGAATCTGCAGGCGCGGC
TCCGGGTCCTGGAGATGTATTTCCTCAATGACACTCTGGCGGCTGAGGACAGCCCGTCCTTCT
CCTTGCTGCAGTCAGCACACCCTGGAGAACACCTGGCTCAGGGTGCATCGAGGCTGCAAGTCC
TGCAGGCCCAACTCACCTGGGTCCGCGTCAGCCATGAGCACTTGCTGCAGCGGGTAGACAACT
TCACTCAGAACCCAGGGATGTTCAGAATCAAAGGTGAACAAGGCGCCCCAGGTCTTCAAGGTC
ACAAGGGGGCCATGGGCATGCCTGGTGCCCCTGGCCCGCCGGGACCACCTGCTGAGAAGGGAG
CCAAGGGGGCTATGGGACGAGATGGAGCAACAGGCCCCTCGGGACCCCAAGGCCCACCGGGAG
TCAAGGGAGAGGCGGGCCTCCAAGGACCCCAGGGTGCTCCAGGGAAGCAAGGAGCCACTGGCA
CCCCAGGACCCCAAGGAGAGAAGGGCAGCAAAGGCGATGGGGGTCTCATTGGCCCAAAAGGGG
AAACTGGAACTAAGGGAGAGAAAGGAGACCTGGGTCTCCCAGGAAGCAAAGGGGACAGGGGCA
TGAAAGGAGATGCAGGGGTCATGGGGCCTCCTGGAGCCCAGGGGAGTAAAGGTGACTTCGGGA
GGCCAGGCCCACCAGGTTTGGCTGGTTTTCCTGGAGCTAAAGGAGATCAAGGACAACCTGGAC
TGCAGGGTGTTCCGGGCCCTCCTGGTGCAGTGGGACACCCAGGTGCCAAGGGTGAGCCTGGCA
GTGCTGGCTCCCCTGGGCGAGCAGGACTTCCAGGGAGCCCCGGGAGTCCAGGAGCCACAGGCC
TGAAAGGAAGCAAAGGGGACACAGGACTTCAAGGACAGCAAGGAAGAAAAGGAGAATCAGGAG
TTCCAGGCCCTGCAGGTGTGAAGGGAGAACAGGGGAGCCCAGGGCTGGCAGGTCCCAAGGGAG
CCCCTGGACAAGCTGGCCAGAAGGGAGACCAGGGAGTGAAAGGATCTTCTGGGGAGCAAGGAG
TAAAGGGAGAAAAAGGTGAAAGAGGTGAAAACTCAGTGTCCGTCAGGATTGTCGGCAGTAGTA
ACCGAGGCCGGGCTGAAGTTTACTACAGTGGTACCTGGGGGACAATTTGCGATGACGAGTGGC
AAAATTCTGATGCCATTGTCTTCTGCCGCATGCTGGGTTACTCCAAAGGAAGGGCCCTGTACA
AAGTGGGAGCTGGCACTGGGCAGATCTGGCTGGATAATGTTCAGTGTCGGGGCACGGAGAGTA
CCCTGTGGAGCTGCACCAAGAATAGCTGGGGCCATCATGACTGCAGCCACGAGGAGGACGCAG
GCGTGGAGTGCAGCGTCTGACCCGGAAACCCTTTCACTTCTCTGCTCCCGAGGTGTCCTCGGG
CTCATATGTGGGAAGGCAGAGGATCTCTGAGGAGTTCCCTGGGGACAACTGAGCAGCCTCTGG
AGAGGGGCCATTAATAAAGCTCAACATCATTGA

FIGURE 332

></usr/seqdb2/sst/DNA/Dnaseqs.full/ss.DNA68886
><subunit 1 of 1, 520 aa, 1 stop
><MW: 52658, pI: 9.16, NX(S/T): 3
MRNKKILKEDELLSETQQAAFHQIAMEPFEINVPKPKRRNGVNFSLAVVVIYLILLTAGAGLL
VVQVLNLQARLRVLEMYFLNDTLAAEDSPSFSLLQSAHPGEHLAQGASRLQVLQAQLTWVRVS
HEHLLQRVDNFTQNPGMFRIKGEQGAPGLQGHKGAMGMPGAPGPPGPPAEKGAKGAMGRDGAT
GPSGPQGPPGVKGEAGLQGPQGAPGKQGATGTPGPQGEKGSKGDGGLIGPKGETGTKGEKGDL
GLPGSKGDRGMKGDAGVMGPPGAQGSKGDFGRPGPPGLAGFPGAKGDQGQPGLQGVPGPPGAV
GHPGAKGEPGSAGSPGRAGLPGSPGSPGATGLKGSKGDTGLQGQQGRKGESGVPGPAGVKGEQ
GSPGLAGPKGAPGQAGQKGDQGVKGSSGEQGVKGEKGERGENSVSVRIVGSSNRGRAEVYYSG
TWGTICDDEWQNSDAIVFCRMLGYSKGRALYKVGAGTGQIWLDNVQCRGTESTLWSCTKNSWG
HHDCSHEEDAGVECSV

Transmembrane domain:
amino acids 47-66 (type II)

N-glycosylation sites.
amino acids 43-47, 83-87, 136-140

Tyrosine kinase phosphorylation site.
amino acids 432-440

N-myristoylation sites.
amino acids 41-47, 178-184, 253-259, 274-280, 340-346, 346-352, 400-406, 441-447, 475-481, 490-496, 515-521

Amidation site.
amino acids 360-364

Leucine zipper pattern.
amino acids 56-78

Speract receptor repeat
amino acids 422-471, 488-519

C1q domain proteins.
amino acids 151-184, 301-334, 316-349

FIGURE 333

GGGCTGTTGATTTGTGGGGGATTTTGAAGAGAGGAGGAATAGGAGGAAGGGGTTGAGGGGCTG
CCTCTGGCATATGCACACACTCACACATTCTGTCACACCCGTCACACACACATACCATGTTCT
CCATCCCCCCAGGTCCAGCCCTCAGTGCTGTCCCATCCAGCAGGGCTACCCTGAAGCTCTGGC
TGCAGCCCTCCCGTCCAGTGGGCAGGCGGCTTCATCCCTCCTTTCTCTCCCAAAGCCCAACTG
CTGTCACTGCATGCTCTGCCAAGGAGGAGGGAACTGCAGTGACAGCAGGAGTAAGAGTGGGAG
GCAGGACAGAGCTGGGACACAGGTATGGAGAGGGGGTTCAGCGAGCCTAGAGAGGGCAGACTA
TCAGGGTGCCGGCGGTGAGAATCCAGGGAGAGGAGCGGAAACAGAAGAGGGGCAGAAGACCGG
GGCACTTGTGGGTTGCAGAGCCCCTCAGCCATGTTGGGAGCCAAGCCACACTGGCTACCAGGT
CCCCTACACAGTCCCGGGCTGCCCTTGGTTCTGGTGCTTCTGGCCCTGGGGGCCGGGTGGGCC
CAGGAGGGGTCAGAGCCCGTCCTGCTGGAGGGGGAGTGCCTGGTGGTCTGTGAGCCTGGCCGA
GCTGCTGCAGGGGGGCCCGGGGGAGCAGCCCTGGGAGAGGCACCCCCTGGGCGAGTGGCATTT
GCTGCGGTCCGAAGCCACCACCATGAGCCAGCAGGGGAAACCGGCAATGGCACCAGTGGGGCC
ATCTACTTCGACCAGGTCCTGGTGAACGAGGGCGGTGGCTTTGACCGGGCCTCTGGCTCCTTC
GTAGCCCCTGTCCGGGGTGTCTACAGCTTCCGGTTCCATGTGGTGAAGGTGTACAACCGCCAA
ACTGTCCAGGTGAGCCTGATGCTGAACACGTGGCCTGTCATCTCAGCCTTTGCCAATGATCCT
GACGTGACCCGGGAGGCAGCCACCAGCTCTGTGCTACTGCCCTTGGACCCTGGGGACCGAGTG
TCTCTGCGCCTGCGTCGGGGGAATCTACTGGGTGGTTGGAAATACTCAAGTTTCTCTGGCTTC
CTCATCTTCCCTCTCTGAGGACCCAAGTCTTTCAAGCACAAGAATCCAGCCCCTGACAACTTT
CTTCTGCCCTCTCTTGCCCCAGAAACAGCAGAGGCAGGAGAGAGACTCCCTCTGGCTCCTATC
CCACCTCTTTGCATGGGACCCTGTGCCAAACACCCAAGTTTAAGAGAAGAGTAGAGCTGTGGC
ATCTCCAGACCAGGCCTTTCCACCCACCCACCCCCAGTTACCCTCCCAGCCACCTGCTGCATC
TGTTCCTGCCTGCAGCCCTAGGATCAGGGCAAGGTTTGGCAAGAAGGAAGATCTGCACTACTT
TGCGGCCTCTGCTCCTCCGGTTCCCCCACCCCAGCTTCCTGCTCAATGCTGATCAGGGACAGG
TGGCGCAGGTGAGCCTGACAGGCCCCCACAGGAGCCCAGATGGACAAGCCTCAGCGTACCCTG
CAGGCTTCTTCCTGTGAGGAAAGCCAGCATCACGGATCTCAGCCAGCACCGTCAGAAGCTGAG
CCAGCACCGTATGGGCTAGGGTGGGAGGCTCAGCCACAGGCAGAAGGGTGGGAAGGGCCTGGA
GTCTGTGGCTGGTGAGGAAGGAAGGAGGGTGTATTGTCTAGACTGAACATGGTACACATTCTG
CATGTATAGCAGAGCAGCCAGCAGGTAGCAATCCTGGCTGTCCTTCTATGCTGGATCCCAGAT
GGACTCTGGCCCTTACCTCCCCACCTGAGATTAGGGTGAGTGTGTTTGCTCTGGCTGAGAGCA
GAGCTGAGAGCAGGTATACAGAGCTGGAAGTGGACCATGGAAAACATCGATAACCATGCATCC
TCTTGCTTGGCCACCTCCTGAAACTGCTCCACCTTTGAAGTTTGAACTTTAGTCCCTCCACAC
TCTGACTGCTGCCTCCTTCCTCCCAGCTCTCTCACTGAGTTATCTTCACTGTACCTGTTCCAG
CATATCCCCACTATCTCTCTTTCTCCTGATCTGTGCTGTCTTATTCTCCTCCTTAGGCTTCCT
ATTACCTGGGATTCCATGATTCATTCCTTCAGACCCTCTCCTGCCAGTATGCTAAACCCTCCC
TCTCTCTTTCTTATCCCGCTGTCCCATTGGCCCAGCCTGGATGAATCTATCAATAAAACAACT
AGAGAATGGTGGTCAGTGAGACACTATAGAATTACTAAGGAGAAGATGCCTCTGGAGTTTGGA
TCGGGTGTTACAGGTACAAGTAGGTATGTTGCAGAGGAAAATAAATATCAAACTGTATACTAA
AATTAAAAA

FIGURE 334

></usr/seqdb2/sst/DNA/Dnaseqs.min/ss.DNA71180
><subunit 1 of 1, 205 aa, 1 stop
><MW: 21521, pI: 7.07, NX(S/T): 1
MLGAKPHWLPGPLHSPGLPLVLVLLALGAGWAQEGSEPVLLEGECLVVCEPGRAAAGGPGGAA
LGEAPPGRVAFAAVRSHHHEPAGETGNGTSGAIYFDQVLVNEGGGFDRASGSFVAPVRGVYSF
RFHVVKVYNRQTVQVSLMLNTWPVISAFANDPDVTREAATSSVLLPLDPGDRVSLRLRRGNLL
GGWKYSSFSGFLIFPL

Signal peptide:
amino acids 1-32

FIGURE 335

GCTGTTTCTCTCGCGCCACCACTGGCCGCCGGCCGCAGCTCCAGGTGTCCTAGCCGCCCAGCC
TCGACGCCGTCCCGGGACCCCTGTGCTCTGCGCGAAGCCCTGGCCCCGGGGGCCGGGGCATGG
GCCAGGGGCGCGGGGTGAAGCGGCTTCCCGCGGGGCCGTGACTGGGCGGGCTTCAGCCATGAA
GACCCTCATAGCCGCCTACTCCGGGGTCCTGCGCGGCGAGCGTCAGGCCGAGGCTGACCGGAG
CCAGCGCTCTCACGGAGGACCTGCGCTGTCGCGCGAGGGGTCTGGGAGATGGGGCACTGGATC
CAGCATCCTCTCCGCCCTCCAGGACCTCTTCTCTGTCACCTGGCTCAATAGGTCCAAGGTGGA
AAAGCAGCTACAGGTCATCTCAGTGCTCCAGTGGGTCCTGTCCTTCCTTGTACTGGGAGTGGC
CTGCAGTGCCATCCTCATGTACATATTCTGCACTGATTGCTGGCTCATCGCTGTGCTCTACTT
CACTTGGCTGGTGTTTGACTGGAACACACCCAAGAAAGGTGGCAGGAGGTCACAGTGGGTCCG
AAACTGGGCTGTGTGGCGCTACTTTCGAGACTACTTTCCCATCCAGCTGGTGAAGACACACAA
CCTGCTGACCACCAGGAACTATATCTTTGGATACCACCCCCATGGTATCATGGGCCTGGGTGC
CTTCTGCAACTTCAGCACAGAGGCCACAGAAGTGAGCAAGAAGTTCCCAGGCATACGGCCTTA
CCTGGCTACACTGGCAGGCAACTTCCGAATGCCTGTGTTGAGGGAGTACCTGATGTCTGGAGG
TATCTGCCCTGTCAGCCGGGACACCATAGACTATTTGCTTTCAAAGAATGGGAGTGGCAATGC
TATCATCATCGTGGTCGGGGGTGCGGCTGAGTCTCTGAGCTCCATGCCTGGCAAGAATGCAGT
CACCCTGCGGAACCGCAAGGGCTTTGTGAAACTGGCCCTGCGTCATGGAGCTGACCTGGTTCC
CATCTACTCCTTTGGAGAGAATGAAGTGTACAAGCAGGTGATCTTCGAGGAGGGCTCCTGGGG
CCGATGGGTCCAGAAGAAGTTCCAGAAATACATTGGTTTCGCCCCATGCATCTTCCATGGTCG
AGGCCTCTTCTCCTCCGACACCTGGGGGCTGGTGCCCTACTCCAAGCCCATCACCACTGTTGT
GGGAGAGCCCATCACCATCCCCAAGCTGGAGCACCCAACCCAGCAAGACATCGACCTGTACCA
CACCATGTACATGGAGGCCCTGGTGAAGCTCTTCGACAAGCACAAGACCAAGTTCGGCCTCCC
GGAGACTGAGGTCCTGGAGGTGAACTGAGCCAGCCTTCGGGGCCAATTCCCTGGAGGAACCAG
CTGCAAATCACTTTTTTGCTCTGTAAATTTGGAAGTGTCATGGGTGTCTGTGGGTTATTTAAA
AGAAATTATAACAATTTTGCTAAACCAAAAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAA

FIGURE 336

></usr/seqdb2/sst/DNA/Dnaseqs.min/ss.DNA71184
><subunit 1 of 1, 388 aa, 1 stop
><MW: 43831, pI: 9.64, NX(S/T): 3
MKTLIAAYSGVLRGERQAEADRSQRSHGGPALSREGSGRWGTGSSILSALQDLFSVTWLNRSK
VEKQLQVISVLQWVLSFLVLGVACSAILMYIFCTDCWLIAVLYFTWLVFDWNTPKKGGRRSQW
VRNWAVWRYFRDYFPIQLVKTHNLLTTRNYIFGYHPHGIMGLGAFCNFSTEATEVSKKFPGIR
PYLATLAGNFRMPVLREYLMSGGICPVSRDTIDYLLSKNGSGNAIIIVVGGAAESLSSMPGKN
AVTLRNRKGFVKLALRHGADLVPIYSFGENEVYKQVIFEEGSWGRWVQKKFQKYIGFAPCIFH
GRGLFSSDTWGLVPYSKPITTVVGEPITIPKLEHPTQQDIDLYHTMYMEALVKLFDKHKTKFG
LPETEVLEVN

Important features of the protein:
Transmembrane domain:
amino acids 76-97

N-glycosylation sites.
amino acids 60-63, 173-176, 228-231

N-myristoylation sites.
amino acids 10-15, 41-46, 84-89, 120-125, 169-174, 229-234, 240-245, 318-323, 378-383

FIGURE 337

GGGCGGCGGGATGGGGGCCGGGGGCGGCGGGCGCCGCACTCGCTGAGGCCCCGACGCAGGGCCGGGCCGGGCCCA
GGGCCGAGGAGCGCGGCGGCCAGAGCGGGGCCGCGGAGGCGACGCCGGGGACGCCCGCGCGACGAGCAGGTGGCG
GCGGCTGCAGGCTTGTCCAGCCGGAAGCCCTGAGGGCAGCTGTTCCCACTGGCTCTGCTGACCTTGTGCCTTGGA
CGGCTGTCCTCAGCGAGGGGCCGTGCACCCGCTCCTGAGCAGCGCCATGGGCCTGCTGGCCTTCCTGAAGACCCA
GTTCGTGCTGCACCTGCTGGTCGGCTTTGTCTTCGTGGTGAGTGGTCTGGTCATCAACTTCGTCCAGCTGTGCAC
GCTGGCGCTCTGGCCGGTCAGCAAGCAGCTCTACCGCCGCCTCAACTGCCGCCTCGCCTACTCACTCTGGAGCCA
ACTGGTCATGCTGCTGGAGTGGTGGTCCTGCACGGAGTGTACACTGTTCACGGACCAGGCCACGGTAGAGCGCTT
TGGGAAGGAGCACGCAGTCATCATCCTCAACCACAACTTCGAGATCGACTTCCTCTGTGGGTGGACCATGTGTGA
GCGCTTCGGAGTGCTGGGGAGCTCCAAGGTCCTCGCTAAGAAGGAGCTGCTCTACGTGCCCCTCATCGGCTGGAC
GTGGTACTTTCTGGAGATTGTGTTCTGCAAGCGGAAGTGGGAGGAGGACCGGGACACCGTGGTCGAAGGGCTGAG
GCGCCTGTCGGACTACCCCGAGTACATGTGGTTTCTCCTGTACTGCGAGGGGACGCGCTTCACGGAGACCAAGCA
CCGCGTTAGCATGGAGGTGGCGGCTGCTAAGGGGCTTCCTGTCCTCAAGTACCACCTGCTGCCGCGGACCAAGGG
CTTCACCACCGCAGTCAAGTGCCTCCGGGGGACAGTCGCAGCTGTCTATGATGTAACCCTGAACTTCAGAGGAAA
CAAGAACCCGTCCCTGCTGGGGATCCTCTACGGGAAGAAGTACGAGGCGGACATGTGCGTGAGGAGATTTCCTCT
GGAAGACATCCCGCTGGATGAAAAGGAAGCAGCTCAGTGGCTTCATAAACTGTACCAGGAGAAGGACGCGCTCCA
GGAGATATATAATCAGAAGGGCATGTTTCCAGGGGAGCAGTTTAAGCCTGCCCGGAGGCCGTGGACCCTCCTGAA
CTTCCTGTCCTGGGCCACCATTCTCCTGTCTCCCCTCTTCAGTTTTGTCTTGGGCGTCTTTGCCAGCGGATCACC
TCTCCTGATCCTGACTTTCTTGGGGTTTGTGGGAGCAGCTTCCTTTGGAGTTCGCAGACTGATAGGAGAATCGCT
TGAACCTGGGAGGTGGAGATTGCAGTGAGCTGAGATGGCATCACTGTACTCCAGCCTAGGCAACAGAGCAAGACT
CAGTCTCAAAAAAAAAAAAAAAACAAAAAAACCCCAGAAATTCTGGAGTTGAACTGTGTAGTTACTGACATGAAAA
ATTCACTAGAGGCTGAACAGCAGATTTGAGCAGGCAGAAAAAAATCAGCAAGCTTGAAGATGGTACCTTGAGATT
TTTCAGGCTAATGAAAAAAGAATGAAGGAAAATTAACAGCCTCAGAGACCCATGGTGCACCGTCACACAAATCAA
CATATGCATGATGAGAGTCCCAGAAGGAGAGGAGAGAAAGGGTCAGAAAGAATGGCCACAAGCTGATGAAAAACA
GTAACCTACCCACTCAGGAAGCTCAGTGAACTCCAATGAGGATGAATATCAGAGATCCACACCTAGATATTTCAT
AATCAAAGTGTCAAATGACAAAGAATCTTGAAAGCAGCAAGAGATGAGCAACTTATCTTGTTCAAAGGATCTTTG
ATCAGATTAACAGCTCATTTCTCCTCAGAAATCATGGAGCCAGGAGATAGTGGGATGAACACTGTTGAAGGCAA
AACCTTCAACTGTAATTATTGGACTTTTGAGTCTTAGATGGTCCTGACCTCTTTGTCTTCAGGGACAGTTTTTCA
ATTTAATCCCTAATAACAATTAGTCAAGCTTCCTTGACCTGTAGGAAGGCCTGTCTTTAGGCCGGGCACAGTGGC
TTACACCTGTAATCCCAGCACTTTGGGAGGCCCAGACGGGTGGATCATTTGGGGTCAGGCTGATCTCAAACTCCT
GAGTTCAGGTGATCTGCCCGCCTCAGCCTCCCAAAGTGTTGTGATTGCAGGCGTGAGCCACTGCGCCTGGCCGGA
ATTTCTTTTTAAGGCTGAATGATGGGGGCCAGGCACGATGGCTCACGCCTGTGATCCCAAGTAGCTTGGATTGTA
AACATGCACCACCATGCCTGGCTAATTTTTGTATTTTTAGTAGAGACGTGTTAGCCAGGCTGGTCTCGATCTCCT
GACCTCAAGTGACCACCTGCCTCAGCCTCCCAAAGTACTGGGATTACAGGCGTGAGCCACTGTGCCTGGCCTTGA
GCATCTTGTGATGTGCTTATTGGCCATTTGTATATCTTCTATCTTCTTTGGGGAAATGTCTGTTCAAGTCCTTTG
CCTTTTTAAATTTTTATTATTTATTTATTTATTTATTTTGAGACAGGGTCTTGTTCTGTTGCCCAGGCTGGAGTA
CAGTGGCACAGTCTTGGCTCACTGCAGCCTCGACCTCCTGGGCTGCAGTGATCCTCCCACCTCAGCCTCCCTTGT
AGCTGTATTTTTTTGTATTTTGTATTTTGTAGCTGTAGTTTTTGTATTTTTTGTGGAGACAGCATTTCACCATGA
TGCCCAGGCTGGTCTTGAACTCCTGAGCTCAAGTGATCTGCCTGCTTCAGCCTCCCAAAGTGCTGGGATTACAGA
CATGAGCCACTGCACCTGGCAAACTCCCAAAATTCAACACACACACACAAAAAACCACCTGATTCAAAATGGGCA
GAGGGGCCGGGTGTGGCCCCAACTACCAGGGAGACTGAAGTGGAGGATCGCTTGGGCATGAGAAGTCGAGGCTG
CAGTGAGTCGAGGTTGTGCGACTGCATTCCAGCCTGGACAACAGAGTGAGACCCTGTCTC

FIGURE 338

></usr/seqdb2/sst/DNA/Dnaseqs.min/ss.DNA71213
><subunit 1 of 1, 368 aa, 1 stop
><MW: 42550, pI: 9.11, NX(S/T): 1
MGLLAFLKTQFVLHLLVGFVFVVSGLVINFVQLCTLALWPVSKQLYRRLNCRLAYSLWSQLVM
LLEWWSCTECTLFTDQATVERFGKEHAVIILNHNFEIDFLCGWTMCERFGVLGSSKVLAKKEL
LYVPLIGWTWYFLEIVFCKRKWEEDRDTVVEGLRRLSDYPEYMWFLLYCEGTRFTETKHRVSM
EVAAAKGLPVLKYHLLPRTKGFTTAVKCLRGTVAAVYDVTLNFRGNKNPSLLGILYGKKYEAD
MCVRRFPLEDIPLDEKEAAQWLHKLYQEKDALQEIYNQKGMFPGEQFKPARRPWTLLNFLSWA
TILLSPLFSFVLGVFASGSPLLILTFLGFVGAASFGVRRLIGESLEPGRWRLQ

Important features of the protein:
Signal peptide:
amino acids 1-25

Transmembrane domains:
amino acids 307-323, 335-352

Tyrosine kinase phosphorylation sites.
amino acids 160-168, 161-169

FIGURE 339

GATATTCTTTATTTTTAAGAATCTGAAGTACTATGCATCACTCCCTCCAATGTCCTGGGGCAG
CCACCAGGCATATTCATCTTTGTGTGTGTTTTTCTTTTGCTTTAGCACTGGGGCACTTCTTGC
TTATTTCTTTGGTAGGAAAGGGGCTCAGTTTGTCTTGTGGGGTTGGTGGCAGGCAGGCCGGCT
TACGCCTGATACGGCCCTGGGTTAGAAGGGAAGGGAAGATAAACTTTTATACAAATGGGGATA
GCTGGGGTCTGAGACCTGCTTCCTCAGTAAAATTCCTGGGATCTGCCTATACCTTCTTTTCTC
TAACCTGGCATACCCTGCTTAAAGCCTCTCAGGGCTTCTCTCTGTTCTTAGGATCAAAGTATT
TAGAGCTACAAGAGCCCTCATGGTCTGGCCCCTGCCCCCCTGGCCAGCTTCATTGTACATGTG
GTGTTCTCTTGTCGTTCCTGTAATGTGGTATGCCATGGGGTCTTTGCACAAGCCTTTCCTCTT
TGGCTGGACACTGTTCCCTGCCCCCCCCATACTCTTCCTACTTAATATGTAGTCATCCTGCAG
ATTTCAATTCTAACATCATTTTCTCCAGGGATCCTGGCCTGACAGAATCTCATCTTGTTTAAT
GCTCTCATAAGACCACTTGTTTCCCTTTTGCAGCACTTGCCACTCAGTTGTATCTTTATGTGC
GTTTGTGGTTGTATGGGTTGTGTCTGTTCCCCAGAATGCCCAGCTCTGAGCTGCGTGAGGGTC
AAGGGCATTGCTGTGCCTGCCAGGTATAGTGCCTACATGTGGTGGGTGCTCATGTTTTAGAGA
CTAAATGGAGGAGGAGATGAGGAAAAGATTGAAATCTCTCAGTTCACCAGATGGTGTAGGGCC
CAGCATTGTAAATTCACACGTTGACTGTGCTTGTGAATTATCTGGGGATGCAGGTCCTGATTC
AGTAGGCCCAGGTTGGGCATCTCTAACAAACTCCCACGTGATGCTGATGCTGGTCCTATGAAC
TATACTAAATAGTAAGAATCTATGGAGCCAGGCTGGGCATGGTGGCTCACACCTATGATCCCA
GCACTTTGGGAGGCTGAGGCAGGCTGATCACCTGGAGTCAGGATTTCAAGACTAGCCTGGCCA
ACATGGTGGAACCCCATCTGTACTAAAAATACACAAATTAGCTGGGCATGGTGGCACATGCCT
GTAGTCCCAGCTACTTGGGAGGCTGAAGCAAGAGAATCGCTTGAACCTGGGAGGCGGAGGTTG
CAGTGAGCCGAGATCAGGCCACTGTATTCCAACCAGGGTGACAGAGTGAGACTCTATGTCCAA
AAAAAAAAAAA

FIGURE 340

></usr/seqdb2/sst/DNA/Dnaseqs.min/ss.DNA71234
><subunit 1 of 1, 143 aa, 1 stop
><MW: 15624, pI: 9.58, NX(S/T): 0
MHHSLQCPGAATRHIHLCVCFSFALALGHFLLISLVGKGLSLSCGVGGRQAGLRLIRPWVRRE
GKINFYTNGDSWGLRPASSVKFLGSAYTFFSLTWHTLLKASQGFSLFLGSKYLELQEPSWSGP
CPPGQLHCTCGVLLSFL

Important features of the protein:
Signal peptide:
amino acids 1-28

FIGURE 341

CGCCATGGCCGGGCTATCCCGCGGGTCCGCGCGCGCACTGCTCGCCGCCCTGCTGGCGTCGACG
CTGTTGGCGCTGCTCGTGTCGCCCGCGCGGGGTCGCGGCGGCCGGGACCACGGGGACTGGGAC
GAGGCCTCCCGGCTGCCGCCGCTACCACCCCGCGAGGACGCGGCGCGCGTGGCCCGCTTCGTG
ACGCACGTCTCCGACTGGGGCGCTCTGGCCACCATCTCCACGCTGGAGGCGGTGCGCGGCCGG
CCCTTCGCCGACGTCCTCTCGCTCAGCGACGGGCCCCCGGGCGCGGGCAGCGGCGTGCCCTAT
TTCTACCTGAGCCCGCTGCAGCTCTCCGTGAGCAACCTGCAGGAGAATCCATATGCTACACTG
ACCATGACTTTGGCACAGACCAACTTCTGCAAGAAACATGGATTTGATCCACAAAGTCCCCTT
TGTGTTCACATAATGCTGTCAGGAACTGTGACCAAGGTGAATGAAACAGAAATGGATATTGCA
AAGCATTCGTTATTCATTCGACACCCTGAGATGAAAACCTGGCCTTCCAGCCATAATTGGTTC
TTTGCTAAGTTGAATATAACCAATATCTGGGTCCTGGACTACTTTGGTGGACCAAAAATCGTG
ACACCAGAAGAATATTATAATGTCACAGTTCAGTGAAGCAGACTGTGGTGAATTTAGCAACAC
TTATGAAGTTTCTTAAAGTGGCTCATACACACTTAAAAGGCTTAATGTTTCTCTGGAAAGCGT
CCCAGAATATTAGCCAGTTTTCTGTC

FIGURE 342

></usr/seqdb2/sst/DNA/Dnaseqs.min/ss.DNA71269
><subunit 1 of 1, 220 aa, 1 stop
><MW: 24075, pI: 7.67, NX(S/T): 3
MAGLSRGSARALLAALLASTLLALLVSPARGRGGRDHGDWDEASRLPPLPPREDAARVAR
FVTHVSDWGALATISTLEAVRGRPFADVLSLSDGPPGAGSGVPYFYLSPLQLSVSNLQEN
PYATLTMTLAQTNFCKKHGFDPQSPLCVHIMLSGTVTKVNETEMDIAKHSLFIRHPEMKT
WPSSHNWFFAKLNITNIWVLDYFGGPKIVTPEEYYNVTVQ

Important features of the protein:
Transmembrane domain:
Amino acids 11-29

N-glycosylation sites:
Amino acids 160-164;193-197;216-220

N-myristoylation sites:
Amino acids 3-9;7-13;69-75;97-103

FIGURE 343

GGCTGGACTGGAACTCCTGGTCCCAAGTGATCCACCCGCCTCAGCCTCCCAAGGTGCTGTGAT
TATAGGTGTAAGCCACCGTGTCTGGCCTCTGAACAACTTTTTCAGCAACTAAAAAAGCCACAG
GAGTTGAACTGCTAGGATTCTGACTATGCTGTGGTGGCTAGTGCTCCTACTCCTACCTACATT
AAAATCTGTTTTTTGTTCTCTTGTAACTAGCCTTTACCTTCCTAACACAGAGGATCTGTCACT
GTGGCTCTGGCCCAAACCTGACCTTCACTCTGGAACGAGAACAGAGGTTTCTACCCACACCGT
CCCCTCGAAGCCGGGGACAGCCTCACCTTGCTGGCCTCTCGCTGGAGCAGTGCCCTCACCAAC
TGTCTCACGTCTGGAGGCACTGACTCGGGCAGTGCAGGTAGCTGAGCCTCTTGGTAGCTGCGG
CTTTCAAGGTGGGCCTTGCCCTGGCCGTAGAAGGGATTGACAAGCCCGAAGATTTCATAGGCG
ATGGCTCCCACTGCCCAGGCATCAGCCTTGCTGTAGTCAATCACTGCCCTGGGGCCAGGACGG
GCCGTGGACACCTGCTCAGAAGCAGTGGGTGAGACATCACGCTGCCCGCCCATCTAACCTTTT
CATGTCCTGCACATCACCTGATCCATGGGCTAATCTGAACTCTGTCCCAAGGAACCCAGAGCT
TGAGTGAGCTGTGGCTCAGACCCAGAAGGGGTCTGCTTAGACCACCTGGTTTATGTGACAGGA
CTTGCATTCTCCTGGAACATGAGGGAACGCCGGAGGAAAGCAAAGTGGCAGGGAAGGAACTTG
TGCCAAATTATGGGTCAGAAAAGATGGAGGTGTTGGGTTATCACAAGGCATCGAGTCTCCTGC
ATTCAGTGGACATGTGGGGGAAGGGCTGCCGATGGCGCATGACACACTCGGGACTCACCTCTG
GGGCCATCAGACAGCCGTTTCCGCCCCGATCCACGTACCAGCTGCTGAAGGGCAACTGCAGGC
CGATGCTCTCATCAGCCAGGCAGCAGCCAAAATCTGCGATCACCAGCCAGGGGCAGCCGTCTG
GGAAGGAGCAAGCAAAGTGACCATTTCTCCTCCCCTCCTTCCCTCTGAGAGGCCCTCCTATGT
CCCTACTAAAGCCACCAGCAAGACATAGCTGACAGGGGCTAATGGCTCAGTGTTGGCCCAGGA
GGTCAGCAAGGCCTGAGAGCTGATCAGAAGGGCCTGCTGTGCGAACACGGAAATGCCTCCAGT
AAGCACAGGCTGCAAAATCCCCAGGCAAAGGACTGTGTGGCTCAATTTAAATCATGTTCTAGT
AATTGGAGCTGTCCCCAAGACCAAAGGAGCTAGAGCTTGGTTCAAATGATCTCCAAGGGCCCT
TATACCCCAGGAGACTTTGATTTGAATTTGAAACCCCAAATCCAAACCTAAGAACCAGGTGCA
TTAAGAATCAGTTATTGCCGGGTGTGGTGGCCTGTAATGCCAACATTTTGGGAGGCCGAGGCG
GGTAGATCACCTGAGGTCAGGAGTTCAAGACCAGCCTGGCCAACATGGTGAAACCCCTGTCTC
TACTAAAAATACAAAAAAACTAGCCAGGCATGGTGGTGTGTGCCTGTATCCCAGCTACTCGGG
AGGCTGAGACAGGAGAATTACTTGAACCTGGGAGGTGAAGGAGGCTGAGACAGGAGAATCACT
TCAGCCTGAGCAACACAGCGAGACTCTGTCTCAGAAAAAATAAAAAAAGAATTATGGTTATTT
GTAA

FIGURE 344

></usr/seqdb2/sst/DNA/Dnaseqs.min/ss.DNA71277
><subunit 1 of 1, 109 aa, 1 stop
><MW: 11822, pI: 8.63, NX(S/T): 0
MLWWLVLLLLPTLKSVFCSLVTSLYLPNTEDLSLWLWPKPDLHSGTRTEVSTHTVPSKPGTAS
PCWPLAGAVPSPTVSRLEALTRAVQVAEPLGSCGFQGGPCPGRRRD

Signal peptide:
amino acids 1-15

FIGURE 345

CCGCCGCCGCAGCCGCTACCGCCGCTGCAGCCGCTTTCCGCGGCCTGGGCCTCTCGCCGTCAG
CATGCCACACGCCTTCAAGCCCGGGGACTTGGTGTTCGCTAAGATGAAGGGCTACCCTCACTG
GCCTGCCAGGATCGACGACATCGCGGATGGCGCCGTGAAGCCCCCACCCAACAAGTACCCCAT
CTTTTTCTTTGGCACACACGAAACAGCCTTCCTGGACCCAAGGACCTGTTCCCCTACGACAA
ATGTAAAGACAAGTACGGGAAGCCCAACAAGAGGAAAGGCTTCAATGAAGGGCTGTGGGAGAT
CCAGAACAACCCCCACGCCAGCTACAGCGCCCCTCCGCCAGTGAGCTCCTCCGACAGCGAGGC
CCCCGAGGCCAACCCCGCCGACGGCAGTGACGCTGACGAGGACGATGAGGACCGGGGGGTCAT
GGCCGTCACAGCGGTAACCGCCACAGCTGCCAGCGACAGGATGGAGAGCGACTCAGACTCAGA
CAAGAGTAGCGACAACAGTGGCCTGAAGAGGAAGACGCCTGCGCTAAAGATGTCGGTCTCGAA
ACGAGCCCGAAAGGCCTCCAGCGACCTGGATCAGGCCAGCGTGTCCCCATCCGAAGAGGAGAA
CTCGGAAAGCTCATCTGAGTCGGAGAAGACCAGCGACCAGGACTTCACACCTGAGAAGAAAGC
AGCGGTCCGGGCGCCACGGAGGGGCCCTCTGGGGGGACGGAAAAAAAAGAAGGCGCCGTCAGC
CTCCGACTCCGACTCCAAGGCCGATTCGGACGGGGCCAAGCCTGAGCCGGTGGCCATGGCGCG
GTCGGCGTCCTCCTCCTCCTCTTCCTCCTCCTCCTCCGACTCCGATGTGTCTGTGAAGAAGCC
TCCGAGGGGCAGGAAGCCAGCGGAGAAGCCTCTCCCGAAGCCGCGAGGGCGGAAACCGAAGCC
TGAACGGCCTCCGTCCAGCTCCAGCAGTGACAGTGACAGCGACGAGGTGGACCGCATCAGTGA
GTGGAAGCGGCGGGACGAGGCGCGGAGGCGCGAGCTGGAGGCCCGGCGGCGGCGAGAGCAGGA
GGAGGAGCTGCGGCGCCTGCGGGAGCAGGAGAAGGAGGAGAAGGAGCGGAGGCGCGAGCGGGC
CGACCGCGGGGAGGCTGAGCGGGGCAGCGGCGGCAGCAGCGGGGACGAGCTCAGGGAGGACGA
TGAGCCCGTCAAGAAGCGGGGACGCAAGGGCCGGGGCCGGGGTCCCCCGTCCTCCTCTGACTC
CGAGCCCGAGGCCGAGCTGGAGAGAGAGGCCAAGAAATCAGCGAAGAAGCCGCAGTCCTCAAG
CACAGAGCCCGCCAGGAAACCTGGCCAGAAGGAGAAGAGAGTGCGGCCCGAGGAGAAGCAACA
AGCCAAGCCCGTGAAGGTGGAGCGGACCCGGAAGCGGTCCGAGGGCTTCTCGATGGACAGGAA
GGTAGAGAAGAAGAAAGAGCCCTCCGTGGAGGAGAAGCTGCAGAAGCTGCACAGTGAGATCAA
GTTTGCCCTAAAGGTCGACAGCCCGGACGTGAAGAGGTGCCTGAATGCCCTAGAGGAGCTGGG
AACCCTGCAGGTGACCTCTCAGATCCTCCAGAAGAACACAGACGTGGTGGCCACCTTGAAGAA
GATTCGCCGTTACAAAGCGAACAAGGACGTAATGGAGAAGGCAGCAGAAGTCTATACCCGGCT
CAAGTCGCGGGTCCTCGGCCCAAAGATCGAGGCGGTGCAGAAAGTGAACAAGGCTGGGATGGA
GAAGGAGAAGGCCGAGGAGAAGCTGGCCGGGGAGGAGCTGGCCGGGGAGGAGGCCCCCCAGGA
GAAGGCGGAGGACAAGCCCAGCACCGATCTCTCAGCCCCAGTGAATGGCGAGGCCACATCACA
GAAGGGGGAGAGCGCAGAGGACAAGGAGCACGAGGAGGGTCGGGACTCGGAGGAGGGGCCAAG
GTGTGGCTCCTCTGAAGACCTGCACGACAGCGTACGGGAGGGTCCCGACCTGGACAGGCCTGG
GAGCGACCGGCAGGAGCGCGAGAGGGCACGGGGGGACTCGGAGGCCCTGGACGAGGAGAGCTG
AGCCGCGGGCAGCCAGGCCCAGCCCCCGCCCGAGCTCAGGCTGCCCCTCTCCTTCCCCGGCTC
GCAGGAGAGCAGAGCAGAGAACTGTGGGGAACGCTGTGCTGTTTGTATTTGTTCCCTTGGGTT
TTTTTTTCCTGCCTAATTTCTGTGATTTCCAACCAACATGAAATGACTATAAACGGTTTTTA
ATGA

FIGURE 346

></usr/seqdb2/sst/DNA/Dnaseqs.min/ss.DNA71286

><subunit 1 of 1, 671 aa, 1 stop

><MW: 74317, pI: 7.61, NX(S/T): 0

MPHAFKPGDLVFAKMKGYPHWPARIDDIADGAVKPPPNKYPIFFFGTHETAFLGPKDLFPYDK
CKDKYGKPNKRKGFNEGLWEIQNNPHASYSAPPPVSSSDSEAPEANPADGSDADEDDEDRGVM
AVTAVTATAASDRMESDSDSDKSSDNSGLKRKTPALKMSVSKRARKASSDLDQASVSPSEEEN
SESSSESEKTSDQDFTPEKKAAVRAPRRGPLGGRKKKKAPSASDSDSKADSDGAKPEPVAMAR
SASSSSSSSSSSDSDVSVKKPPRGRKPAEKPLPKPRGRKPKPERPPSSSSSDSDSDEVDRISE
WKRRDEARRRELEARRRREQEEELRRLREQEKEEKERRRERADRGEAERGSGGSSGDELREDD
EPVKKRGRKGRGRGPPSSSDSEPEAELEREAKKSAKKPQSSSTEPARKPGQKEKRVRPEEKQQ
AKPVKVERTRKRSEGFSMDRKVEKKKEPSVEEKLQKLHSEIKFALKVDSPDVKRCLNALEELG
TLQVTSQILQKNTDVVATLKKIRRYKANKDVMEKAAEVYTRLKSRVLGPKIEAVQKVNKAGME
KEKAEEKLAGEELAGEEAPQEKAEDKPSTDLSAPVNGEATSQKGESAEDKEHEEGRDSEEGPR
CGSSEDLHDSVREGPDLDRPGSDRQERERARGDSEALDEES

Signal peptide:

amino acids 1-13

FIGURE 347

GTTGGTTCTCCTGGATCTTCACCTTACCAACTGCAGATCTTGGGACTCATCAGCCTCAATAATTATATTAAATTA
ACACCATTTGAAAGAGAACATTGTTTTCATCATGAATGCTAATAAAGATGAAAGACTTAAAGCCAGAAGCCAAGA
TTTTCACCTTTTTCCTGCTTTGATGATGCTAAGCATGACCATGTTGTTTCTTCCAGTCACTGGCACTTTGAAGCA
AAATATTCCAAGACTCAAGCTAACCTACAAAGACTTGCTGCTTTCAAATAGCTGTATTCCCTTTTTGGGTTCATC
AGAAGGACTGGATTTTCAAACTCTTCTCTTAGATGAGGAAAGAGGCAGGCTGCTCTTGGGAGCCAAAGACCACAT
CTTTCTACTCAGTCTGGTTGACTTAAACAAAAATTTTAAGAAGATTTATTGGCCTGCTGCAAAGGAACGGGTGGA
ATTATGTAAATTAGCTGGGAAAGATGCCAATACAGAATGTGCAAATTTCATCAGAGTACTTCAGCCCTATAACAA
AACTCACATATATGTGTGTGGAACTGGAGCATTTCATCCAATATGTGGGTATATTGATCTTGGAGTCTACAAGGA
GGATATTATATTCAAACTAGACACACATAATTTGGAGTCTGGCAGACTGAAATGTCCTTTCGATCCTCAGCAGCC
TTTTGCTTCAGTAATGACAGATGAGTACCTCTACTCTGGAACAGCTTCTGATTTCCTTGGCAAAGATACTGCATT
CACTCGATCCCTTGGGCCTACTCATGACCACCACTACATCAGAACTGACATTTCAGAGCACTACTGGCTCAATGG
AGCAAAATTTATTGGAACTTTCTTCATACCAGACACCTACAATCCAGATGATGATAAAATATATTTCTTCTTTCG
TGAATCATCTCAAGAAGGCAGTACCTCCGATAAAACCATCCTTTCTCGAGTTGGAAGAGTTTGTAAGAATGATGT
AGGAGGACAACGCAGCCTGATAAACAAGTGGACGACTTTTCTTAAGGCCAGACTGATTTGCTCAATTCCTGGAAG
TGATGGGGCAGATACTTACTTTGATGAGCTTCAAGATATTTATTTACTCCCCACAAGAGATGAAAGAAATCCTGT
AGTATATGGAGTCTTTACTACAACCAGCTCCATCTTCAAAGGCTCTGCTGTTTGTGTGTATAGCATGGCTGACAT
CAGAGCAGTTTTTAATGGTCCATATGCTCATAAGGAAAGTGCAGACCATCGTTGGGTGCAGTATGATGGGAGAAT
TCCTTATCCACGGCCTGGTACATGTCCAAGCAAAACCTATGACCCACTGATTAAGTCCACCCGAGATTTTCCAGA
TGATGTCATCAGTTTCATAAAGCGGCACTCTGTGATGTATAAGTCCGTATACCCAGTTGCAGGAGGACCAACGTT
CAAGAGAATCAATGTGGATTACAGACTGACACAGATAGTGGTGGATCATGTCATTGCAGAAGATGGCCAGTACGA
TGTAATGTTTCTTGGAACAGACATTGGAACTGTCCTCAAAGTTGTCAGCATTTCAAAGGAAAAGTGGAATATGGA
AGAGGTAGTGCTGGAGGAGTTGCAGATATTCAAGCACTCATCAATCATCTTGAACATGGAATTGTCTCTGAAGCA
GCAACAATTGTACATTGGTTCCCGAGATGGATTAGTTCAGCTCTCCTTGCACAGATGCGACACTTATGGGAAAGC
TTGCGCAGACTGTTGTCTTGCCAGAGACCCCTACTGTGCCTGGGATGGAAATGCATGCTCTCGATATGCTCCTAC
TTCTAAAAGGAGAGCTAGACGCCAAGATGTAAAATATGGCGACCCAATCACCCAGTGCTGGGACATCGAAGACAG
CATTAGTCATGAAACTGCTGATGAAAAGGTGATTTTTGGCATTGAATTTAACTCAACCTTTCTGGAATGTATACC
TAAATCCCAACAAGCAACTATTAAATGGTATATCCAGAGGTCAGGGGATGAGCATCGAGAGGAGTTGAAGCCCGA
TGAAAGAATCATCAAAACGGAATATGGGCTACTGATTCGAAGTTTGCAGAAGAAGGATTCTGGGATGTATTACTG
CAAAGCCCAGGAGCACACTTTCATCCACACCATAGTGAAGCTGACTTTGAATGTCATTGAGAATGAACAGATGGA
AAATACCCAGAGGGCAGAGCATGAGGAGGGGCAGGTCAAGGATCTATTGGCTGAGTCACGGTTGAGATACAAAGA
CTACATCCAAATCCTTAGCAGCCCAAACTTCAGCCTCGACCAGTACTGCGAACAGATGTGGCACAGGGAGAAGCG
GAGACAGAGAAACAAGGGGGGCCCAAAGTGGAAGCACATGCAGGAAATGAAGAAGAAACGAAATCGAAGACATCA
CAGAGACCTGGATGAGCTCCCTAGAGCTGTAGCCACGTAGTTTTCTACTTAATTTAAAGAAAAGAATTCCTTACC
TATAAAAACATTGCCTTCTGTTTTGTATATCCCTTATAGTAATTCATAAATGCTTCCCATGGAGTTTTGCTAAGG
CACAAGACAATAATCTGAATAAGACAATATGTGATGAATATAAGAAAGGGCAAAAAATTCATTTGAACCAGTTTT
CCAAGAACAAATCTTGCACAAGCAAAGTATAAGAATTATCCTAAAAATAGGGGGTTTACAGTTGTAAATGTTTTA
TGTTTTGAGTTTTGGAATTTATTGTCATGTAAATAGTTGAGCTAAGCAAGCCCCGAATTTGATAGTGTATAAGGT
GCTTTATTCCCTCGAATGTCCATTAAGCATGGAATTTACCATGCAGTTGTGCTATGTTCTTATGAACAGATATAT
CATTCCTATTGAGAACCAGCTACCTTGTGGTAGGGAATAAGAGGTCAGACACAAATTAAGACAACTCCCATTATC
AACAGGAACTTTCTCAGTGAGCCATTCACTCCTGGAGAATGGTATAGGAATTTGGAGAGGTGCATTATTTCTTTC
TGGCCACTGGGGTTAAATTTAGTGTACTACAACATTGATTTACTGAAGGGCACTAATGTTTCCCCCAGGATTTCT
ATTGACTAGTCAGGAGTAACAGGTTCACAGAGAGAAGTTGGTGCTTAGTTATGTGTTTTTTAGAGTATATACTAA
GCTCTACAGGGACAGAATGCTTAATAAATACTTTAATAAGATATGGAAAATATTTTAATAAAACAAGGAAAACA
TAATGATGTATAATGCATCCTGATGGGAAGGCATGCAGATGGGATTTGTTAGAAGACAGAAGGAAAGACAGCCAT
AAATTCTGGCTTTGGGGAAAACTCATATCCCCATGAAAAGGAAGAACAATCACAAATAAAGTGAGAGTAATGTAA
TGGAGCTCTTTTCACTAGGGTATAAGTAGCTGCCAATTTGTAATTCATCTGTTAAAAAAAATCTAGATTATAACA
AACTGCTAGCAAAATCTGAGGAAACATAAATTCTTCTGAAGAATCATAGGAAGAGTAGACATTTTATTTATAACC
AATGATATTTCAGTATATATTTTCTCTCTTTTAAAAAATATTTATCATACTCTGTATATTATTTCTTTTTACTGC
CTTTATTCTCTCCTGTATATTGGATTTTGTGATTATATTTGAGTGAATAGGAGAAAACAATATATAACACACAGA
GAATTAAGAAAATGACATTTCTGGGGAGTGGGATATATATTTGTTGAATAACAGAACGAGTGTAAAATTTTAAC
AACGGAAAGGGTTAAATTAACTCTTTGACATCTTCACTCAACCTTTTCTCATTGCTGAGTTAATCTGTTGTAATT
GTAGTATTGTTTTTGTAATTTAACAATAAATAAGCCTGCTACATGT

FIGURE 348

></usr/seqdb2/sst/DNA/Dnaseqs.min/ss.DNA71883
><subunit 1 of 1, 777 aa, 1 stop
><MW: 89651, pI: 7.97, NX(S/T): 3

MNANKDERLKARSQDFHLFPALMMLSMTMLFLPVTGTLKQNIPRLKLTYKDLLLSNSCIPFLG
SSEGLDFQTLLLDEERGRLLLGAKDHIFLLSLVDLNKNFKKIYWPAAKERVELCKLAGKDANT
ECANFIRVLQPYNKTHIYVCGTGAFHPICGYIDLGVYKEDIIFKLDTHNLESGRLKCPFDPQQ
PFASVMTDEYLYSGTASDFLGKDTAFTRSLGPTHDHHYIRTDISEHYWLNGAKFIGTFFIPDT
YNPDDDKIYFFFRESSQEGSTSDKTILSRVGRVCKNDVGGQRSLINKWTTFLKARLICSIPGS
DGADTYFDELQDIYLLPTRDERNPVVYGVFTTTSSIFKGSAVCVYSMADIRAVFNGPYAHKES
ADHRWVQYDGRIPYPRPGTCPSKTYDPLIKSTRDFPDDVISFIKRHSVMYKSVYPVAGGPTFK
RINVDYRLTQIVVDHVIAEDGQYDVMFLGTDIGTVLKVVSISKEKWNMEEVVLEELQIFKHSS
IILNMELSLKQQQLYIGSRDGLVQLSLHRCDTYGKACADCCLARDPYCAWDGNACSRYAPTSK
RRARRQDVKYGDPITQCWDIEDSISHETADEKVIFGIEFNSTFLECIPKSQQATIKWYIQRSG
DEHREELKPDERIIKTEYGLLIRSLQKKDSGMYYCKAQEHTFIHTIVKLTLNVIENEQMENTQ
RAEHEEGQVKDLLAESRLRYKDYIQILSSPNFSLDQYCEQMWHREKRRQRNKGGPKWKHMQEM
KKKRNRRHHRDLDELPRAVAT

Important features of the protein:

Signal peptide:

amino acids 1-36

N-glycosylation sites.

amino acids 139-142, 607-610, 724-727

Tyrosine kinase phosphorylation site.

amino acids 571-576

Gram-positive cocci surface proteins 'anchoring' hexapeptide.

amino acids 32-37

FIGURE 349

CCCTGACCTCCCTGAGCCACACTGAGCTGGAAGCCGCAGAGGTCATCCTGGAGCATGCCCACCGCGGGGAGCAGA
CAACCTCCCAGGTAAGCTGGGAGCAAGACCTGAAGCTGTTTCTTCAGGAGCCTGGTGTATTTTCCCCCACCCCAC
CTCAGCAGTTTCAGCCAGCAGGGACTGATCAGGTGTGTGTCCTGGAGTGGGGAGCAGAAGGCGTGGCTGGCAAGA
GTGGCCTGGAGAAAGAGGTTCAGCGCTTGACCAGCCGAGCTGCCCGTGACTACAAGATCCAGAACCATGGGCATC
GGGTGAGGTGGGGGGGCACAGGTGTCATGTGCACCTTCTTGTCTCAGCAAGAAGAGCTGAGAGAGGGGATCTTGG
AGCCATTGAGGGTGTCATGGAGCTACAGAGGGGAGGGAAAGGTATTTTAAGGTAACAGTGTGGCACAATAGTTAA
GAGCACAGTTTTTGGAGCTAGACCGACATAGGTTCAAATTCTCTTCTGTTGCTTCCTAGTTCTGTAGCCCCAGGT
AAGGGAGTGACTTAACCTCTCTGGACTTCAATTTCCTCATCACTAAAGTAGGGCCAATAATAGCACCCACCTCAT
AGGGAAGATTAAATGACATAATGTATGTGATGCAACTAGCAAAGTACCAGTCCCATAGTAAGTCATGCCCCACAG
TATTTCCACCCACCCCTGTTCTCTGCCTTCCCAACCAGGTACTGCAACGACTGGAGCAGAGGCGGCAGCAGGCTT
CAGAGCGGGAGGCTCCAAGCATAGAACAGAGGTTACAGGAAGTGCGAGAGAGCATCCGCCGGGCACAGGTGAGCC
AGGTGAAGGGGGCTGCCCGGCTGGCCCTGCTGCAGGGGGCTGGCTTAGATGTGGAGCGCTGGCTGAAGCCAGCCA
TGACCCAGGCCCAGGATGAGGTGGAGCAGGAGCGGCGGCTCAGTGAGGCTCGGCTGTCCCAGAGGGACCTCTCTC
CAACCGCTGAGGATGCTGAGCTTTCTGACTTTGAGGAATGTGAGGAGACGGGAGAGCTCTTTGAGGAGCCTGCCC
CCCAAGCCCTGGCCACGAGGGCCCTCCCCTGCCCTGCACACGTGGTATTTCGCTATCAGGCAGGGCGTGAGGATG
AGCTGACAATCACGGAGGGTGAGTGGCTGGAGGTCATAGAGGAGGGAGATGCTGACGAATGGGTCAAGGCTCGGA
ACCAGCACGGCGAGGTAGGCTTTGTCCCTGAGCGATATCTCAACTTCCCGGACCTCTCCCTCCCAGAGAGCAGCC
AAGACAGTGACAATCCCTGCGGGGCAGAGCCCACAGCATTCCTGGCACAGGCCCTGTACAGCTACACCGGACAGA
GTGCAGAGGAGCTGAGCTTCCCTGAGGGGGCACTCATCCGTCTGCTGCCCCGGGCCCAAGATGGAGTAGATGACG
GCTTCTGGAGGGGAGAATTTGGGGGCCGTGTTGGGGTCTTCCCCTCCCTGCTGGTGGAAGAGCTGCTTGGCCCCC
CAGGGCCACCTGAACTCTCTGACCCTGAACAGATGCTGCCGTCCCCTTCTCCTCCCAGCTTCTCCCCACCTGCAC
CTACCTCTGTGTTGGATGGCCCCCTGCACCTGTCCTGCCTGGGGACAAAGCCCTGGACTTCCCTGGGTTCCTGG
ACATGATGGCACCTCGACTCAGGCCGATGCGTCCACCACCTCCCCCGCCGGCTAAAGCCCCGGATCCTGGCCACC
CAGATCCCCTCACCTGAAGGCCAGGGAAGCCTTGACCCCCAGTGATGCTGCTGTCCCTATCTTCAAGCTGTCAGA
CCACACCATCAATGATCCAGAGCAACACAGCCAAAAGCTGGAATCGCCCTTATTTCCACCCTCACCTCCAAGGGT
GGAAACTTGCCCCTTCCCATTTCTAGAGCTGGAACCCACTCCTTTTTTTCCCATTGTTCTATCATCTCTAGGACC
GGAACTACTACCTTCTCTTCTGTCATGACCCTATCTAGGGTGGTGAAATGCCTGAAATCTCTGGGGCTGGAAACC
ATCCATCAAGGTCTCTAGTAGTTCTGGCCCACCTCTTTCCCCACCCTGGCTCCATGACCCACCCCACTCTGGATG
CCAGGGTCACTGGGGTTGGGCTGGGGAGAGGAACAGGCCTTGGGAATCAGGAGCTGGAGCCAGGATGCGAAGCAG
CTGTAATGGTCTGAGCGGATTTATTGACAATGAATAAAGGGCACGAAGGCCAGGCCAGGGCCTGGGCCTCTTGTG
CTAAGAGGGCAGGGGGCCTACGGTGCTATTGCTTTAGGGGCCCACCACGGGCAGGGGCCTGCTCCCAGCTGCCAC
GCTCTATCATATGGAGCGAGGTGTTGGGGAAGGCGGGGCAGGCAGCCTGTTGCAGGCAGGGGAAGGAGAAGAGAC
TGAGGGGCTGTGACCTCTCCTGAGGCCCCCAGCCTGAGACTGTGCAACTCCAGGTGGAAGTAGAGCTGGTCCCTC
AGCTGGGGGGCAGTGCTGTCCAGTGGAGGGGAGGGCTTTCACGCCCACCCACCCCCTGGCCCTGCCAGCTGGTAG
TCCATCAGCACAATGAAGGAGACTTGGAGAAGAGGAAGAATAACACTGTTGCTTCCTGTTCAAGCTGTGTCCAGC
TTTTCCCCTGGGGCTCCAGGACCTTCCCTACCTCCACCACCAAACCAAGGGATTTATAGCAAAGGCTAAGCCTGC
AGTTTACTCTGGGGGTTCAGGGAGCCGAAAGGCTTAAATAGTTTAAGTAGGTGATGGGAAGATGAGATTACCTCA
TTTAGGGCTCAGGCAGACTCACCTCACATACTCCCTGCTCCCTGTGGTAGAGACACCTGAGAGAAAGGGGAGGGG
TCAACAATGAGAGACCAGGAGTAGGTCCTATCAGTGCCCCCCAGAGTAGAGAGCAATAAGAGCCCAGCCCAGTGC
AGTCCCGGCTGTGTTTTCCTACCTGGTGATCAGAAGTGTCTGGTTTGCTTGGCTGCCCATTTGCCTCTTGAGTGG
GCAGCCCTGGGCTTGGGCCCCTCCCTCCGGCCCTCAGTGTTGGCTCTGCAGAAGCTCTGGGGTTCCCTTCAAGTG
CACGAGGGGTTAGGCTGCTGTCCCTGAGTCCTCCATTCTGTACTGGGGGGCTGGCTAGGACCTGGGGCTGTGGCC
TCTCAGGGGGCAGCCTCTCCATGGCAGGCATCCCTGCCTTGGGCTGCCCTCCCCCAGACCCCTGACCACCCCCTG
GGTCCTGTCCCCCACCAGAGCCCCAGCTCCTGTCTGTGGGGGAGCCATCACGGTGTTCGTGCAGTCCATAGCGCT
TCTCAATGTGTGTCACCCGGAACCTGGGAGGGGAGGGAACACTGGGGTTTAGGACCACAACTCAGAGGCTGCTTG
GCCCTCCCCTCTGACCAGGGACATCCTGAGTTTGGTGGCTACTTCCCTCTGGCCTAAGGTAGGGGAGGCCTTCTC
AGATTGTGGGGCACATTGTGTAGCCTGACTTCTGCTGGAGCTCCCAGTCCAGGAGGAAAGAGCCAAGGCCCACTT
TTGGGATCAGGTGCCTGATCACTGGGCCCCCTACCTCAGCCCCCCTTTCCCTGGAGCACCTGCCCCACCTGCCCA
CAGAGAACACAGTGGTCTCCCCTGTCCGGGGGGCGGCTTTTTCCTTCCTTGGAGCGTCCCTGACGGACAAGTGGAG
GCCTCTTGCTGCGGCTGCAATGGATGCAAGGGGCTGCAGAGCCCAGGTGCACTGTGTGATGATGGGAGGGGGCTC
CGTCCTGCAGGCTGGAGGTGGCATCCACACTGGACAGCAGGAGGAGGGGAGTGAGGGTAACATTTCCATTTCCCT
TCATGTTTTGTTTCTTACGTTCTTTCAGCATGCTCCTTAAAACCCCAGAAGCCCCAATTTCCCCAAGCCCCATTT
TTTCTTGTCTTTATCTAATAAACTCAATATTAAG

FIGURE 350

></usr/seqdb2/sst/DNA/Dnaseqs.min/ss.DNA73401
><subunit 1 of 1, 370 aa, 1 stop
><MW: 40685, pI: 4.53, NX(S/T): 0
MQLAKYQSHSKSCPTVFPPTPVLCLPNQVLQRLEQRRQQASEREAPSIEQRLQEVRESIRRAQ
VSQVKGAARLALLQGAGLDVERWLKPAMTQAQDEVEQERRLSEARLSQRDLSPTAEDAELSDF
EECEETGELFEEPAPQALATRALPCPAHVVFRYQAGREDELTITEGEWLEVIEEGDADEWVKA
RNQHGEVGFVPERYLNFPDLSLPESSQDSDNPCGAEPTAFLAQALYSYTGQSAEELSFPEGAL
IRLLPRAQDGVDDGFWRGEFGGRVGVFPSLLVEELLGPPGPPELSDPEQMLPSPSPPSFSPPA
PTSVLDGPPAPVLPGDKALDFPGFLDMMAPRLRPMRPPPPPPAKAPDPGHPDPLT

FIGURE 351A

CACAGGGAGACCCACAGACACATATGCACGAGAGAGACAGAGGAGGAAAGAGACAGAGACAAAGGCACAGCGGAA
GAAGGCAGAGACAGGGCAGGCACAGAAGCGGCCCAGACAGAGTCCTACAGAGGGAGAGGCCAGAGAAGCTGCAGA
AGACACAGGCAGGGAGAGACAAAGATCCAGGAAAGGAGGGCTCAGGAGGAGAGTTTGGAGAAGCCAGACCCCTGG
GCACCTCTCCCAAGCCCAAGGACTAAGTTTTCTCCATTTCCTTTAACGGTCCTCAGCCCTTCTGAAAACTTTGCC
TCTGACCTTGGCAGGAGTCCAAGCCCCCAGGCTACAGAGAGGAGCTTTCCAAAGCTAGGGTGTGGAGGACTTGGT
GCCCTAGACGGCCTCAGTCCCTCCCAGCTGCAGTACCAGTGCCATGTCCCAGACAGGCTCGCATCCCGGGAGGGG
CTTGGCAGGGCGCTGGCTGTGGGGAGCCCAACCCTGCCTCCTGCTCCCCATTGTGCCGCTCTCCTGGCTGGTGTG
GCTGCTTCTGCTACTGCTGGCCTCTCTCCTGCCCTCAGCCCGGCTGGCCAGCCCCCTCCCCCGGGAGGAGGAGAT
CGTGTTTCCAGAGAAGCTCAACGGCAGCGTCCTGCCTGGCTCGGGCGCCCCTGCCAGGCTGTTGTGCCGCTTGCA
GGCCTTTGGGGAGACGCTGCTACTAGAGCTGGAGCAGGACTCCGGTGTGCAGGTCGAGGGGCTGACAGTGCAGTA
CCTGGGCCAGGCGCCTGAGCTGCTGGGTGGAGCAGAGCCTGGCACCTACCTGACTGGCACCATCAATGGAGATCC
GGAGTCGGTGGCATCTCTGCACTGGGATGGGGGAGCCCTGTTAGGCGTGTTACAATATCGGGGGGCTGAACTCCA
CCTCCAGCCCCTGGAGGGAGGCACCCCTAACTCTGCTGGGGGACCTGGGGCTCACATCCTACGCCGGAAGAGTCC
TGCCAGCGGTCAAGGTCCCATGTGCAACGTCAAGGCTCCTCTTGGAAGCCCCAGCCCCAGACCCCGAAGAGCCAA
GCGCTTTGCTTCACTGAGTAGATTTGTGGAGACACTGGTGGTGGCAGATGACAAGATGGCCGCATTCCACGGTGC
GGGGCTAAAGCGCTACCTGCTAACAGTGATGGCAGCAGCAGCCAAGGCCTTCAAGCACCCAAGCATCCGCAATCC
TGTCAGCTTGGTGGTGACTCGGCTAGTGATCCTGGGGTCAGGCGAGGAGGGGCCCCAAGTGGGGCCCAGTGCTGC
CCAGACCCTGCGCAGCTTCTGTGCCTGGCAGCGGGGCCTCAACACCCCTGAGGACTCGGGCCCTGACCACTTTGA
CACAGCCATTCTGTTTACCCGTCAGGACCTGTGTGGAGTCTCCACTTGCGACACGCTGGGTATGGCTGATGTGGG
CACCGTCTGTGACCCGGCTCGGAGCTGTGCCATTGTGGAGGATGATGGGCTCCAGTCAGCCTTCACTGCTGCTCA
TGAACTGGGTCATGTCTTCAACATGCTCCATGACAACTCCAAGCCATGCATCAGTTTGAATGGGCCTTTGAGCAC
CTCTCGCCATGTCATGGCCCCTGTGATGGCTCATGTGGATCCTGAGGAGCCCTGGTCCCCCTGCAGTGCCCGCTT
CATCACTGACTTCCTGGACAATGGCTATGGGCACTGTCTCTTAGACAAACCAGAGGCTCCATTGCATCTGCCTGT
GACTTTCCCTGGCAAGGACTATGATGCTGACCGCCAGTGCCAGCTGACCTTCGGGCCCGACTCACGCCATTGTCC
ACAGCTGCCGCCGCCCTGTGCTGCCCTCTGGTGCTCTGGCCACCTCAATGGCCATGCCATGTGCCAGACCAAACA
CTCGCCCTGGGCCGATGGCACACCCTGCGGGCCCGCACAGGCCTGCATGGGTGGTCGCTGCCTCCACATGGACCA
GCTCCAGGACTTCAATATTCCACAGGCTGGTGGCTGGGGTCCTTGGGGACCATGGGGTGACTGCTCTCGGACCTG
TGGGGGTGGTGTCCAGTTCTCCTCCCGAGACTGCACGAGGCCTGTCCCCCGGAATGGTGGCAAGTACTGTGAGGG
CCGCCGTACCCGCTTCCGCTCCTGCAACACTGAGGACTGCCCAACTGGCTCAGCCCTGACCTTCCGCGAGGAGCA
GTGTGCTGCCTACAACCACCGCACCGACCTCTTCAAGAGCTTCCCAGGGCCCATGGACTGGGTTCCTCGCTACAC
AGGCGTGGCCCCCCAGGACCAGTGCAAACTCACCTGCCAGGCCCGGGCACTGGGCTACTACTATGTGCTGGAGCC
ACGGGTGGTAGATGGGACCCCCTGTTCCCCGGACAGCTCCTCGGTCTGTGTCCAGGGCCGATGCATCCATGCTGG
CTGTGATCGCATCATTGGCTCCAAGAAGAAGTTTGACAAGTGCATGGTGTGCGGAGGGGACGGTTCTGGTTGCAG
CAAGCAGTCAGGCTCCTTCAGGAAATTCAGGTACGGATACAACAATGTGGTCACTATCCCCGCGGGGGCCACCCA
CATTCTTGTCCGGCAGCAGGGAAACCCTGGCCACCGGAGCATCTACTTGGCCCTGAAGCTGCCAGATGGCTCCTA
TGCCCTCAATGGTGAATACACGCTGATGCCCTCCCCCACAGATGTGGTACTGCCTGGGGCAGTCAGCTTGCGCTA
CAGCGGGGCCACTGCAGCCTCAGAGACACTGTCAGGCCATGGGCCACTGGCCCAGCCTTTGACACTGCAAGTCCT
AGTGGCTGGCAACCCCCAGGACACACGCCTCCGATACAGCTTCTTCGTGCCCCGGCCGACCCCTTCAACGCCACG
CCCCACTCCCCAGGACTGGCTGCACCGAAGAGCACAGATTCTGGAGATCCTTCGGCGGCGCCCCTGGGCGGGCAG
GAAATAACCTCACTATCCCGGCTGCCCTTTCTGGGCACCGGGGCCTCGGACTTAGCTGGGAGAAAGAGAGAGCTT
CTGTTGCTGCCTCATGCTAAGACTCAGTGGGGAGGGGCTGTGGGCGTGAGACCTGCCCCTCCTCTCTGCCCTAAT
GCGCAGGCTGGCCCTGCCCTGGTTTCCTGCCCTGGGAGGCAGTGATGGGTTAGTGGATGGAAGGGGCTGACAGAC
AGCCCTCCATCTAAACTGCCCCCTCTGCCCTGCGGGTCACAGGAGGGAGGGGGAAGGCAGGGAGGGCCTGGGCCC
CAGTTGTATTTATTTAGTATTTATTCACTTTTATTTAGCACCAGGGAAGGGGACAAGGACTAGGGTCCTGGGGAA
CCTGACCCCTGACCCCTCATAGCCCTCACCCTGGGGCTAGGAAATCCAGGGTGGTGGTGATAGGTATAAGTGGTG
TGTGTATGCGTGTGTGTGTGTGTGTGAAAATGTGTGTGTGCTTATGTATGAGGTACAACCTGTTCTGCTTTCCTC
TTCCTGAATTTTATTTTTTGGGAAAAGAAAAGTCAAGGGTAGGGTGGGCCTTCAGGGAGTGAGGGATTATCTTTT
TTTTTTTTTCTTTCTTTCTTTCTTTTTTTTTTTTGAGACAGAATCTCGCTCTGTCGCCCAGGCTGGAGTGCAATG
GCACAATCTCGGCTCACTGCATCCTCCGCCTCCCGGGTTCAAGTGATTCTCATGCCTCAGCCTCCTGAGTAGCTG
GGATTACAGGCTCCTGCCACCACGCCCAGCTAATTTTTGTTTTGTTTTGTTTGGAGACAGAGTCTCGCTATTGTC
ACCAGGGCTGGAATGATTTCAGCTCACTGCAACCTTCGCCACCTGGGTTCCAGCAATTCTCCTGCCTCAGCCTCC
CGAGTAGCTGAGATTATAGGCACCTACCACCACGCCCGGCTAATTTTTGTATTTTTAGTAGAGACGGGGTTTCAC
CATGTTGGCCAGGCTGGTCTCGAACTCCTGACCTTAGGTGATCCACTCGCCTTCATCTCCCAAAGTGCTGGGATT
ACAGGCGTGAGCCACCGTGCCTGGCCACGCCCAACTAATTTTTGTATTTTTAGTAGAGACAGGGTTTCACCATGT
TGGCCAGGCTGCTCTTGAACTCCTGACCTCAGGTAATCGACCTGCCTCGGCCTCCCAAAGTGCTGGGATTACAGG

FIGURE 351B

```
TGTGAGCCACCACGCCCGGTACATATTTTTTAAATTGAATTCTACTATTTATGTGATCCTTTTGGAGTCAGACAG
ATGTGGTTGCATCCTAACTCCATGTCTCTGAGCATTAGATTTCTCATTTGCCAATAATAATACCTCCCTTAGAAG
TTTGTTGTGAGGATTAAATAATGTAAATAAAGAACTAGCATAACACTCAAAAAAAAAAAAAAAAAAAAAAAAAAA
AAAAAAAAAAAAAAAAAAAAAAAAAAAAAAAAAAAAAAAAAAAAAAAAAAAAAGGAAA
```

FIGURE 352

></usr/seqdb2/sst/DNA/Dnaseqs.min/ss.DNA73492
><subunit 1 of 1, 837 aa, 1 stop
><MW: 90167, pI: 8.39, NX(S/T): 1
MSQTGSHPGRGLAGRWLWGAQPCLLLPIVPLSWLVWLLLLLLASLLPSARLASPLPREEEIVF
PEKLNGSVLPGSGAPARLLCRLQAFGETLLLELEQDSGVQVEGLTVQYLGQAPELLGGAEPGT
YLTGTINGDPESVASLHWDGGALLGVLQYRGAELHLQPLEGGTPNSAGGPGAHILRRKSPASG
QGPMCNVKAPLGSPSPRPRRAKRFASLSRFVETLVVADDKMAAFHGAGLKRYLLTVMAAAAKA
FKHPSIRNPVSLVVTRLVILGSGEEGPQVGPSAAQTLRSFCAWQRGLNTPEDSGPDHFDTAIL
FTRQDLCGVSTCDTLGMADVGTVCDPARSCAIVEDDGLQSAFTAAHELGHVFNMLHDNSKPCI
SLNGPLSTSRHVMAPVMAHVDPEEPWSPCSARFITDFLDNGYGHCLLDKPEAPLHLPVTFPGK
DYDADRQCQLTFGPDSRHCPQLPPPCAALWCSGHLNGHAMCQTKHSPWADGTPCGPAQACMGG
RCLHMDQLQDFNIPQAGGWGPWGPWGDCSRTCGGGVQFSSRDCTRPVPRNGGKYCEGRRTRFR
SCNTEDCPTGSALTFREEQCAAYNHRTDLFKSFPGPMDWVPRYTGVAPQDQCKLTCQARALGY
YYVLEPRVVDGTPCSPDSSSVCVQGRCIHAGCDRIIGSKKKFDKCMVCGGDGSGCSKQSGSFR
KFRYGYNNVVTIPAGATHILVRQQGNPGHRSIYLALKLPDGSYALNGEYTLMPSPTDVVLPGA
VSLRYSGATAASETLSGHGPLAQPLTLQVLVAGNPQDTRLRYSFFVPRPTPSTPRPTPQDWLH
RRAQILEILRRRPWAGRK
Important features of the protein:
Signal peptide:
amino acids 1-48
N-glycosylation site.
amino acids 68-71
Glycosaminoglycan attachment site
amino acids 188-191, 772-775
cAMP- and cGMP-dependent protein kinase phosphorylation site.
amino acids 182-185
Tyrosine kinase phosphorylation site.
amino acids 730-736
N-myristoylation sites.
amino acids 5-10, 19-24, 121-126, 125-130, 130-135, 147-152, 167-172, 168-173, 174-179, 323-328, 352-357, 539-544, 555-560, 577-582, 679-684, 682-687, 763-768
Amidation sites.
amino acids 560-563, 834-837
Leucine zipper pattern.
amino acids 17-38, 24-45
Neutral zinc metallopeptidases, zinc-binding region signature.
amino acids 358-367

FIGURE 353

GCGGAACTGGCTCCGGCTGGCACCTGAGGAGCGGCGTGACCCCGAGGGCCCAGGGAGCTGCCC
GGCTGGCCTAGGCAGGCAGCCGCACCATGGCCAGCACGGCCGTGCAGCTTCTGGGCTTCCTGC
TCAGCTTCCTGGGCATGGTGGGCACGTTGATCACCACCATCCTGCCGCACTGGCGGAGGACAG
CGCACGTGGGCACCAACATCCTCACGGCCGTGTCCTACCTGAAAGGGCTCTGGATGGAGTGTG
TGTGGCACAGCACAGGCATCTACCAGTGCCAGATCTACCGATCCCTGCTGGCGCTGCCCCAAG
ACCTCCAGGCTGCCCGCGCCCTCATGGTCATCTCCTGCCTGCTCTCGGGCATAGCCTGCGCCT
GCGCCGTCATCGGGATGAAGTGCACGCGCTGCGCCAAGGGCACACCCGCCAAGACCACCTTTG
CCATCCTCGGCGGCACCCTCTTCATCCTGGCCGGCCTCCTGTGCATGGTGGCCGTCTCCTGGA
CCACCAACGACGTGGTGCAGAACTTCTACAACCCGCTGCTGCCCAGCGGCATGAAGTTTGAGA
TTGGCCAGGCCCTGTACCTGGGCTTCATCTCCTCGTCCCTCTCGCTCATTGGTGGCACCCTGC
TTTGCCTGTCCTGCCAGGACGAGGCACCCTACAGGCCCTACCAGGCCCCGCCCAGGGCCACCA
CGACCACTGCAAACACCGCACCTGCCTACCAGCCACCAGCTGCCTACAAAGACAATCGGGCCC
CCTCAGTGACCTCGGCCACGCACAGCGGGTACAGGCTGAACGACTACGTGTGAGTCCCCACAG
CCTGCTTCTCCCCTGGGCTGCTGTGGGCTGGGTCCCCGGCGGGACTGTCAATGGAGGCAGGGG
TTCCAGCACAAAGTTTACTTCTGGGCAATTTTTGTATCCAAGGAAATAATGTGAATGCGAGGA
AATGTCTTTAGAGCACAGGGACAGAGGGGGAAATAAGAGGAGGAGAAAGCTCTCTATACCAAA
GACTGAAAAAAAAAATCCTGTCTGTTTTTGTATTTATTATATATATTTATGTGGGTGATTTGA
TAACAAGTTTAATATAAAGTGACTTGGGAGTTTGGTCAGTGGGGTTGGTTTGTGATCCAGGAA
TAAACCTTGCGGATGTGGCTGTTTATGAAAAAAAAAAAAA

FIGURE 354

MASTAVQLLGFLLSFLGMVGTLITTILPHWRRTAHVGTNILTAVSYLKGLWMECVWHSTGIYQ
CQIYRSLLALPQDLQAARALMVISCLLSGIACACAVIGMKCTRCAKGTPAKTTFAILGGTLFI
LAGLLCMVAVSWTTNDVVQNFYNPLLPSGMKFEIGQALYLGFISSSLSLIGGTLLCLSCQDEA
PYRPYQAPPRATTTTANTAPAYQPPAAYKDNRAPSVTSATHSGYRLNDYV

Important features of the protein:

Signal peptide:

amino acids 1-21

Transmembrane domains:

amino acids 82-103, 115-141, 160-182

FIGURE 355

GAGCTCCCCTCAGGAGCGCGTTAGCTTCACACCTTCGGCAGCAGGAGGGCGGCAGCTTCTCGC
AGGCGGCAGGGCGGGCGGCCAGGATCATGTCCACCACCACATGCCAAGTGGTGGCGTTCCTCC
TGTCCATCCTGGGGCTGGCCGGCTGCATCGCGGCCACCGGGATGGACATGTGGAGCACCCAGG
ACCTGTACGACAACCCCGTCACCTCCGTGTTCCAGTACGAAGGGCTCTGGAGGAGCTGCGTGA
GGCAGAGTTCAGGCTTCACCGAATGCAGGCCCTATTTCACCATCCTGGGACTTCCAGCCATGC
TGCAGGCAGTGCGAGCCCTGATGATCGTAGGCATCGTCCTGGGTGCCATTGGCCTCCTGGTAT
CCATCTTTGCCCTGAAATGCATCCGCATTGGCAGCATGGAGGACTCTGCCAAAGCCAACATGA
CACTGACCTCCGGGATCATGTTCATTGTCTCAGGTCTTTGTGCAATTGCTGGAGTGTCTGTGT
TTGCCAACATGCTGGTGACTAACTTCTGGATGTCCACAGCTAACATGTACACCGGCATGGGTG
GGATGGTGCAGACTGTTCAGACCAGGTACACATTTGGTGCGGCTCTGTTCGTGGGCTGGGTCG
CTGGAGGCCTCACACTAATTGGGGGTGTGATGATGTGCATCGCCTGCCGGGGCCTGGCACCAG
AAGAAACCAACTACAAAGCCGTTTCTTATCATGCCTCAGGCCACAGTGTTGCCTACAAGCCTG
GAGGCTTCAAGGCCAGCACTGGCTTTGGGTCCAACACCAAAAACAAGAAGATATACGATGGAG
GTGCCCGCACAGAGGACGAGGTACAATCTTATCCTTCCAAGCACGACTATGTGTAATGCTCTA
AGACCTCTCAGCACGGGCGGAAGAAACTCCCGGAGAGCTCACCCAAAAAACAAGGAGATCCCA
TCTAGATTTCTTCTTGCTTTTGACTCACAGCTGGAAGTTAGAAAAGCCTCGATTTCATCTTTG
GAGAGGCCAAATGGTCTTAGCCTCAGTCTCTGTCTCTAAATATTCCACCATAAAACAGCTGAG
TTATTTATGAATTAGAGGCTATAGCTCACATTTTCAATCCTCTATTTCTTTTTTTAAATATAA
CTTTCTACTCTGATGAGAGAATGTGGTTTTAATCTCTCTCTCACATTTTGATGATTTAGACAG
ACTCCCCCTCTTCCTCCTAGTCAATAAACCCATTGATGATCTATTTCCCAGCTTATCCCCAAG
AAAACTTTTGAAAGGAAAGAGTAGACCCAAAGATGTTATTTTCTGCTGTTTGAATTTTGTCTC
CCCACCCCCAACTTGGCTAGTAATAAACACTTACTGAAGAAGAAGCAATAAGAGAAAGATATT
TGTAATCTCTCCAGCCCATGATCTCGGTTTTCTTACACTGTGATCTTAAAAGTTACCAAACCA
AAGTCATTTTCAGTTTGAGGCAACCAAACCTTTCTACTGCTGTTGACATCTTCTTATTACAGC
AACACCATTCTAGGAGTTTCCTGAGCTCTCCACTGGAGTCCTCTTTCTGTCGCGGGTCAGAAA
TTGTCCCTAGATGAATGAGAAAATTATTTTTTTTAATTTAAGTCCTAAATATAGTTAAAATAA
ATAATGTTTTAGTAAAATGATACACTATCTCTGTGAAATAGCCTCACCCCTACATGTGGATAG
AAGGAAATGAAAAAATAATTGCTTTGACATTGTCTATATGGTACTTTGTAAAGTCATGCTTAA
GTACAAATTCCATGAAAAGCTCACACCTGTAATCCTAGCACTTTGGGAGGCTGAGGAGGAAGG
ATCACTTGAGCCCAGAAGTTCGAGACTAGCCTGGGCAACATGGAGAAGCCCTGTCTCTACAAA
ATACAGAGAGAAAAAATCAGCCAGTCATGGTGGCATACACCTGTAGTCCCAGCATTCCGGGAG
GCTGAGGTGGGAGGATCACTTGAGCCCAGGGAGGTTGGGGCTGCAGTGAGCCATGATCACACC
ACTGCACTCCAGCCAGGTGACATAGCGAGATCCTGTCTAAAAAAATAAAAAATAAATAATGGA
ACACAGCAAGTCCTAGGAAGTAGGTTAAAACTAATTCTTTAA

FIGURE 356

></usr/seqdb2/sst/DNA/Dnaseqs.min/ss.DNA73734

><subunit 1 of 1, 261 aa, 1 stop

><MW: 27856, pI: 8.50, NX(S/T): 1

MSTTTCQVVAFLLSILGLAGCIAATGMDMWSTQDLYDNPVTSVFQYEGLWRSCVRQSSGFTEC
RPYFTILGLPAMLQAVRALMIVGIVLGAIGLLVSIFALKCIRIGSMEDSAKANMTLTSGIMFI
VSGLCAIAGVSVFANMLVTNFWMSTANMYTGMGGMVQTVQTRYTFGAALFVGWVAGGLTLIGG
VMMCIACRGLAPEETNYKAVSYHASGHSVAYKPGGFKASTGFGSNTKNKKIYDGGARTEDEVQ
SYPSKHDYV

Signal peptide:

amino acids 1-23

Transmembrane domains:

amino acids 81-100, 121-141, 173-194

FIGURE 357

GGAAAAACTGTTCTCTTCTGTGGCACAGAGAACCCTGCTTCAAAGCAGAAGTAGCAGTTCCGG
AGTCCAGCTGGCTAAAACTCATCCCAGAGGATAATGGCAACCCATGCCTTAGAAATCGCTGGG
CTGTTTCTTGGTGGTGTTGGAATGGTGGGCACAGTGGCTGTCACTGTCATGCCTCAGTGGAGA
GTGTCGGCCTTCATTGAAAACAACATCGTGGTTTTTGAAAACTTCTGGGAAGGACTGTGGATG
AATTGCGTGAGGCAGGCTAACATCAGGATGCAGTGCAAAATCTATGATTCCCTGCTGGCTCTT
TCTCCGGACCTACAGGCAGCCAGAGGACTGATGTGTGCTGCTTCCGTGATGTCCTTCTTGGCT
TTCATGATGGCCATCCTTGGCATGAAATGCACCAGGTGCACGGGGGACAATGAGAAGGTGAAG
GCTCACATTCTGCTGACGGCTGGAATCATCTTCATCATCACGGGCATGGTGGTGCTCATCCCT
GTGAGCTGGGTTGCCAATGCCATCATCAGAGATTTCTATAACTCAATAGTGAATGTTGCCCAA
AAACGTGAGCTTGGAGAAGCTCTCTACTTAGGATGGACCACGGCACTGGTGCTGATTGTTGGA
GGAGCTCTGTTCTGCTGCGTTTTTTGTTGCAACGAAAAGAGCAGTAGCTACAGATACTCGATA
CCTTCCCATCGCACAACCCAAAAAAGTTATCACACCGGAAAGAAGTCACCGAGCGTCTACTCC
AGAAGTCAGTATGTGTAGTTGTGTATGTTTTTTTAACTTTACTATAAAGCCATGCAAATGACA
AAAATCTATATTACTTTCTCAAAATGGACCCCAAAGAAACTTTGATTTACTGTTCTTAACTGC
CTAATCTTAATTACAGGAACTGTGCATCAGCTATTTATGATTCTATAAGCTATTTCAGCAGAA
TGAGATATTAAACCCAATGCTTTGATTGTTCTAGAAAGTATAGTAATTTGTTTTCTAAGGTGG
TTCAAGCATCTACTCTTTTTATCATTTACTTCAAAATGACATTGCTAAAGACTGCATTATTTT
ACTACTGTAATTTCTCCACGACATAGCATTATGTACATAGATGAGTGTAACATTTATATCTCA
CATAGAGACATGCTTATATGGTTTTATTTAAAATGAAATGCCAGTCCATTACACTGAATAAAT
AGAACTCAACTATTGCTTTTCAGGGAAATCATGGATAGGGTTGAAGAAGGTTACTATTAATTG
TTTAAAAACAGCTTAGGGATTAATGTCCTCCATTTATAATGAAGATTAAAATGAAGGCTTTAA
TCAGCATTGTAAAGGAAATTGAATGGCTTTCTGATATGCTGTTTTTAGCCTAGGAGTTAGAA
ATCCTAACTTCTTTATCCTCTTCTCCCAGAGGCTTTTTTTTTCTTGTGTATTAAATTAACATT
TTTAAAACGCAGATATTTTGTCAAGGGGCTTTGCATTCAAACTGCTTTTCCAGGGCTATACTC
AGAAGAAAGATAAAAGTGTGATCTAAGAAAAAGTGATGGTTTTAGGAAAGTGAAAATATTTTT
GTTTTTGTATTTGAAGAAGAATGATGCATTTTGACAAGAAATCATATATGTATGGATATATTT
TAATAAGTATTTGAGTACAGACTTTGAGGTTTCATCAATATAAATAAAAGAGCAGAAAAATAT
GTCTTGGTTTTCATTTGCTTACCAAAAAAACAACAACAAAAAAAGTTGTCCTTTGAGAACTTC
ACCTGCTCCTATGTGGGTACCTGAGTCAAAATTGTCATTTTTGTTCTGTGAAAAATAAATTTC
CTTCTTGTACCATTTCTGTTTAGTTTTACTAAAATCTGTAAATACTGTATTTTTCTGTTTATT
CCAAATTTGATGAAACTGACAATCCAATTTGAAAGTTTGTGTCGACGTCTGTCTAGCTTAAAT
GAATGTGTTCTATTTGCTTTATACATTTATATTAATAAATTGTACATTTTTCTAATT

FIGURE 358

></usr/seqdb2/sst/DNA/Dnaseqs.min/ss.DNA73735

><subunit 1 of 1, 225 aa, 1 stop

><MW: 24845, pI: 9.07, NX(S/T): 0

MATHALEIAGLFLGGVGMVGTVAVTVMPQWRVSAFIENNIVVFENFWEGLWMNCVRQANIRMQ
CKIYDSLLALSPDLQAARGLMCAASVMSFLAFMMAILGMKCTRCTGDNEKVKAHILLTAGIIF
IITGMVVLIPVSWVANAIIRDFYNSIVNVAQKRELGEALYLGWTTALVLIVGGALFCCVFCCN
EKSSSYRYSIPSHRTTQKSYHTGKKSPSVYSRSQYV

Signal peptide:

amino acids 1-17

Transmembrane domains:

amino acids 82-101, 118-145, 164-188

FIGURE 359

CCCGCGCCCGGTTCTCCCTCGCAGCACCTCGAAGTGCGCCCCTCGCCCTCCTGCTCGCGCCCC
GCCGCCATGGCTGCCTCCCCCGCGCGGCCTGCTGTCCTGGCCCTGACCGGGCTGGCGCTGCTC
CTGCTCCTGTGCTGGGGCCCAGGTGGCATAAGTGGAAATAAACTCAAGCTGATGCTTCAAAAA
CGAGAAGCACCTGTTCCAACTAAGACTAAAGTGGCCGTTGATGAGAATAAAGCCAAAGAATTC
CTTGGCAGCCTGAAGCGCCAGAAGCGGCAGCTGTGGGACCGGACTCGGCCCGAGGTGCAGCAG
TGGTACCAGCAGTTTCTCTACATGGGCTTTGATGAAGCGAAATTTGAAGATGACATCACCTAT
TGGCTTAACAGAGATCGAAATGGACATGAATACTATGGCGATTACTACCAACGTCACTATGAT
GAAGACTCTGCAATTGGTCCCCGGAGCCCCTACGGCTTTAGGCATGGAGCCAGCGTCAACTAC
GATGACTACTAACCATGACTTGCCACACGCTGTACAAGAAGCAAATAGCGATTCTCTTCATGT
ATCTCCTAATGCCTTACACTACTTGGTTTCTGATTTGCTCTATTTCAGCAGATCTTTTCTACC
TACTTTGTGTGATCAAAAAAGAAGAGTTAAAACAACACATGTAAATGCCTTTTGATATTTCAT
GGGAATGCCTCTCATTTAAAAATAGAAATAAAGCATTTTGTTAAAAAGA

FIGURE 360

></usr/seqdb2/sst/DNA/Dnaseqs.min/ss.DNA73742

><subunit 1 of 1, 148 aa, 1 stop

><MW: 17183, pI: 8.77, NX(S/T): 0

MAASPARPAVLALTGLALLLLLCWGPGGISGNKLKLMLQKREAPVPTKTKVAVDENKAKEFLG
SLKRQKRQLWDRTRPEVQQWYQQFLYMGFDEAKFEDDITYWLNRDRNGHEYYGDYYQRHYDED
SAIGPRSPYGFRHGASVNYDDY

Signal peptide:

amino acids 1-30

FIGURE 361

GAGATTGGAAACAGCCAGGTTGGAGCAGTGAGTGAGTAAGGAAACCTGGCTGCCCTCTCCAGA
TTCCCCAGGCTCTCAGAGAAGATCAGCAGAAAGTCTGCAAGACCCTAAGAACCATCAGCCCTC
AGCTGCACCTCCTCCCCTCCAAGGATGACAAAGGCGCTACTCATCTATTTGGTCAGCAGCTTT
CTTGCCCTAAATCAGGCCAGCCTCATCAGTCGCTGTGACTTGGCCCAGGTGCTGCAGCTGGAG
GACTTGGATGGGTTTGAGGGTTACTCCCTGAGTGACTGGCTGTGCCTGGCTTTTGTGGAAAGC
AAGTTCAACATATCAAAGATAAATGAAAATGCGGATGGAAGCTTTGACTATGGCCTCTTCCAG
ATCAACAGCCACTACTGGTGCAACGATTATAAGAGTTACTCGGAAAACCTTTGCCACGTAGAC
TGTCAAGATCTGCTGAATCCCAACCTTCTTGCAGGCATCCACTGCGCAAAAAGGATTGTGTCC
GGAGCACGGGGGATGAACAACTGGGTAGAATGGAGGTTGCACTGTTCAGGCCGGCCACTCTCC
TACTGGCTGACAGGATGCCGCCTGAGATGAAACAGGGTGCGGGTGCACCGTGGAGTCATTCCA
AGACTCCTGTCCTCACTCAGGGATTCTTCATTTCTTCTTCCTACTGCCTCCACTTCATGTTAT
TTTCTTCCCTTCCCATTTACAACTAAAACTGACCAGAGCCCCAGGAATAAATGGTTTTCTTGG
CTTCCTCCTTACTCCCATCTGGACCCAGTCCCCTGGTTCCTGTCTGTTATTTGTAAACTGAGG
ACCACAATAAAGAAATCTTTATATTTATCG

FIGURE 362

></usr/seqdb2/sst/DNA/Dnaseqs.min/ss.DNA73746

><subunit 1 of 1, 148 aa, 1 stop

><MW: 16896, pI: 6.05, NX(S/T): 1

MTKALLIYLVSSFLALNQASLISRCDLAQVLQLEDLDGFEGYSLSDWLCLAFVESKFNISKIN
ENADGSFDYGLFQINSHYWCNDYKSYSENLCHVDCQDLLNPNLLAGIHCAKRIVSGARGMNNW
VEWRLHCSGRPLSYWLTGCRLR

Signal peptide:

amino acids 1-18

FIGURE 363

TCTGACCTGACTGGAAGCGTCCAAAGAGGGACGGCTGTCAGCCCTGCTTGACTGAGAACCCAC
CAGCTCATCCCAGACACCTCATAGCAACCTATTTATACAAAGGGGGAAAGAAACACCTGAGCA
GAATGGAATCATTATTTTTTTCCCAAGGAGAAAACCGGGGTAAAGGGAGGGAAGCAATTCAAT
TTGAAGTCCCTGTGAATGGGCTTTCAGAAGGCAATTAAAGAAATCCACTCAGAGAGGACTTGG
GGTGAAACTTGGGTCCTGTGGTTTTCTGATTGTAAGTGGAAGCAGGTCTTGCACACGCTGTTG
GCAAATGTCAGGACCAGGTTAAGTGACTGGCAGAAAAACTTCCAGGTGGAACAAGCAACCCAT
GTTCTGCTGCAAGCTTGAAGGAGCCTGGAGCGGGAGAAAGCTAACTTGAACATGACCTGTTGC
ATTTGGCAAGTTCTAGCAACATGCTCCTAAGGAAGCGATACAGGCACAGACCATGCAGACTCC
AGTTCCTCCTGCTGCTCCTGATGCTGGGATGCGTCCTGATGATGGTGGCGATGTTGCACCCTC
CCCACCACACCCTGCACCAGACTGTCACAGCCCAAGCCAGCAAGCACAGCCCTGAAGCCAGGT
ACCGCCTGGACTTTGGGGAATCCCAGGATTGGGTACTGGAAGCTGAGGATGAGGGTGAAGAGT
ACAGCCCTCTGGAGGGCCTGCCACCCTTTATCTCACTGCGGGAGGATCAGCTGCTGGTGGCCG
TGGCCTTACCCCAGGCCAGAAGGAACCAGAGCCAGGGCAGGAGAGGTGGGAGCTACCGCCTCA
TCAAGCAGCCAAGGAGGCAGGATAAGGAAGCCCCAAAGAGGGACTGGGGGGCTGATGAGGACG
GGGAGGTGTCTGAAGAAGAGGAGTTGACCCCGTTCAGCCTGGACCCACGTGGCCTCCAGGAGG
CACTCAGTGCCCGCATCCCCCTCCAGAGGGCTCTGCCCGAGGTGCGGCACCCACTGTGTCTGC
AGCAGCACCCTCAGGACAGCCTGCCCACAGCCAGCGTCATCCTCTGTTTCCATGATGAGGCCT
GGTCCACTCTCCTGCGGACTGTACACAGCATCCTCGACACAGTGCCCAGGGCCTTCCTGAAGG
AGATCATCCTCGTGGACGACCTCAGCCAGCAAGGACAACTCAAGTCTGCTCTCAGCGAATATG
TGGCCAGGCTGGAGGGGGTGAAGTTACTCAGGAGCAACAAGAGGCTGGGTGCCATCAGGGCCC
GGATGCTGGGGGCCACCAGAGCCACCGGGGATGTGCTCGTCTTCATGGATGCCCACTGCGAGT
GCCACCCAGGCTGGCTGGAGCCCCTCCTCAGCAGAATAGCTGGTGACAGGAGCCGAGTGGTAT
CTCCGGTGATAGATGTGATTGACTGGAAGACTTTCCAGTATTACCCCTCAAAGGACCTGCAGC
GTGGGGTGTTGGACTGGAAGCTGGATTTCCACTGGGAACCTTTGCCAGAGCATGTGAGGAAGG
CCCTCCAGTCCCCCATAAGCCCCATCAGGAGCCCTGTGGTGCCCGGAGAGGTGGTGGCCATGG
ACAGACATTACTTCCAAAACACTGGAGCGTATGACTCTCTTATGTCGCTGCGAGGTGGTGAAA
ACCTCGAACTGTCTTTCAAGGCCTGGCTCTGTGGTGGCTCTGTTGAAATCCTTCCCTGCTCTC
GGGTAGGACACATCTACCAAAATCAGGATTCCCATTCCCCCCTCGACCAGGAGGCCACCCTGA
GGAACAGGGTTCGCATTGCTGAGACCTGGCTGGGGTCATTCAAAGAAACCTTCTACAAGCATA
GCCCAGAGGCCTTCTCCTTGAGCAAGGCTGAGAAGCCAGACTGCATGGAACGCTTGCAGCTGC
AAAGGAGACTGGGTTGTCGGACATTCCACTGGTTTCTGGCTAATGTCTACCCTGAGCTGTACC
CATCTGAACCCAGGCCCAGTTTCTCTGGAAAGCTCCACAACACTGGACTTGGGCTCTGTGCAG
ACTGCCAGGCAGAAGGGGACATCCTGGGCTGTCCCATGGTGTTGGCTCCTTGCAGTGACAGCC
GGCAGCAACAGTACCTGCAGCACACCAGCAGGAAGGAGATTCACTTTGGCAGCCCACAGCACC
TGTGCTTTGCTGTCAGGCAGGAGCAGGTGATTCTTCAGAACTGCACGGAGGAAGGCCTGGCCA
TCCACCAGCAGCACTGGGACTTCCAGGAGAATGGGATGATTGTCCACATTCTTTCTGGGAAAT
GCATGGAAGCTGTGGTGCAAGAAAACAATAAAGATTTGTACCTGCGTCCGTGTGATGGAAAAG
CCCGCCAGCAGTGGCGATTTGACCAGATAAATGCTGTGGATGAACGATGAATGTCAATGTCAG
AAGGAAAAGAGAATTTTGGCCATCAAAATCCAGCTCCAAGTGAACGTAAAGAGCTTATATATT
TCATGAAGCTGATCCTTTTGTGTGTGTGCTCCTTGTGTTAGGAGAGAAAAAAGCTCTATGAAA
GAATATAGGAAGTTTCTCCTTTTCACACCTTATTTCATTGACTGCTGGCTGCTTA

FIGURE 364

></usr/seqdb2/sst/DNA/Dnaseqs.min/ss.DNA73760

><subunit 1 of 1, 639 aa, 1 stop

><MW: 73063, pI: 6.84, NX(S/T): 2

MLLRKRYRHRPCRLQFLLLLLMLGCVLMMVAMLHPPHHTLHQTVTAQASKHSPEARYRLDFGE
SQDWVLEAEDEGEEYSPLEGLPPFISLREDQLLVAVALPQARRNQSQGRRGGSYRLIKQPRRQ
DKEAPKRDWGADEDGEVSEEEELTPFSLDPRGLQEALSARIPLQRALPEVRHPLCLQQHPQDS
LPTASVILCFHDEAWSTLLRTVHSILDTVPRAFLKEIILVDDLSQQGQLKSALSEYVARLEGV
KLLRSNKRLGAIRARMLGATRATGDVLVFMDAHCECHPGWLEPLLSRIAGDRSRVVSPVIDVI
DWKTFQYYPSKDLQRGVLDWKLDFHWEPLPEHVRKALQSPISPIRSPVVPGEVVAMDRHYFQN
TGAYDSLMSLRGGENLELSFKAWLCGGSVEILPCSRVGHIYQNQDSHSPLDQEATLRNRVRIA
ETWLGSFKETFYKHSPEAFSLSKAEKPDCMERLQLQRRLGCRTFHWFLANVYPELYPSEPRPS
FSGKLHNTGLGLCADCQAEGDILGCPMVLAPCSDSRQQQYLQHTSRKEIHFGSPQHLCFAVRQ
EQVILQNCTEEGLAIHQQHWDFQENGMIVHILSGKCMEAVVQENNKDLYLRPCDGKARQQWRF
DQINAVDER

Signal peptide:

amino acids 1-28

FIGURE 365

GGAGAGAGGCGCGCGGGTGAAAGGCGCATTGATGCAGCCTGCGGCGGCCTCGGAGCGCGGCGG
AGCCAGACGCTGACCACGTTCCTCTCCTCGGTCTCCTCCGCCTCCAGCTCCGCGCTGCCCGGC
AGCCGGGAGCCATGCGACCCCAGGGCCCCGCCGCCTCCCCGCAGCGGCTCCGCGGCCTCCTGC
TGCTCCTGCTGCTGCAGCTGCCCGCGCCGTCGAGCGCCTCTGAGATCCCCAAGGGGAAGCAAA
AGGCGCAGCTCCGGCAGAGGGAGGTGGTGGACCTGTATAATGGAATGTGCTTACAAGGGCCAG
CAGGAGTGCCTGGTCGAGACGGGAGCCCTGGGGCCAATGTTATTCCGGGTACACCTGGGATCC
CAGGTCGGGATGGATTCAAAGGAGAAAAGGGGGAATGTCTGAGGGAAAGCTTTGAGGAGTCCT
GGACACCCAACTACAAGCAGTGTTCATGGAGTTCATTGAATTATGGCATAGATCTTGGGAAAA
TTGCGGAGTGTACATTTACAAAGATGCGTTCAAATAGTGCTCTAAGAGTTTTGTTCAGTGGCT
CACTTCGGCTAAAATGCAGAAATGCATGCTGTCAGCGTTGGTATTTCACATTCAATGGAGCTG
AATGTTCAGGACCTCTTCCCATTGAAGCTATAATTTATTTGGACCAAGGAAGCCCTGAAATGA
ATTCAACAATTAATATTCATCGCACTTCTTCTGTGGAAGGACTTTGTGAAGGAATTGGTGCTG
GATTAGTGGATGTTGCTATCTGGGTTGGCACTTGTTCAGATTACCCAAAAGGAGATGCTTCTA
CTGGATGGAATTCAGTTTCTCGCATCATTATTGAAGAACTACCAAAATAAATGCTTTAATTTT
CATTTGCTACCTCTTTTTTTATTATGCCTTGGAATGGTTCACTTAAATGACATTTTAAATAAG
TTTATGTATACATCTGAATGAAAAGCAAAGCTAAATATGTTTACAGACCAAAGTGTGATTTCA
CACTGTTTTTAAATCTAGCATTATTCATTTTGCTTCAATCAAAAGTGGTTTCAATATTTTTTT
TAGTTGGTTAGAATACTTTCTTCATAGTCACATTCTCTCAACCTATAATTTGGAATATTGTTG
TGGTCTTTTGTTTTTTCTCTTAGTATAGCATTTTTAAAAAAATATAAAAGCTACCAATCTTTG
TACAATTTGTAAATGTTAAGAATTTTTTTATATCTGTTAAATAAAAATTATTTCCAACA

FIGURE 366

></usr/seqdb2/sst/DNA/Dnaseqs.min/ss.DNA76393

><subunit 1 of 1, 243 aa, 1 stop

><MW: 26266, pI: 8.43, NX(S/T): 1

MRPQGPAASPQRLRGLLLLLLLQLPAPSSASEIPKGKQKAQLRQREVVDLYNGMCLQGPAGVP
GRDGSPGANVIPGTPGIPGRDGFKGEKGECLRESFEESWTPNYKQCSWSSLNYGIDLGKIAEC
TFTKMRSNSALRVLFSGSLRLKCRNACCQRWYFTFNGAECSGPLPIEAIIYLDQGSPEMNSTI
NIHRTSSVEGLCEGIGAGLVDVAIWVGTCSDYPKGDASTGWNSVSRIIIEELPK

Signal peptide:

amino acids 1-30

Transmembrane domain:

amino acids 195-217

FIGURE 367

GTTAACCAGCGCAGTCCTCCGTGCGTCCCGCCCGCCGCTGCCCTCACTCCCGGCCAGGATGGC
ATCCTGTCTGGCCCTGCGCATGGCGCTGCTGCTGGTCTCCGGGGTTCTGGCCCCTGCGGTGCT
CACAGACGATGTTCCACAGGAGCCCGTGCCCACGCTGTGGAACGAGCCGGCCGAGCTGCCGTC
GGGAGAAGGCCCCGTGGAGAGCACCAGCCCCGGCCGGGAGCCCGTGGACACCGGTCCCCCAGC
CCCCACCGTCGCGCCAGGACCCGAGGACAGCACCGCGCAGGAGCGGCTGGACCAGGGCGGCGG
GTCGCTGGGGCCCGGCGCTATCGCGGCCATCGTGATCGCCGCCCTGCTGGCCACCTGCGTGGT
GCTGGCGCTCGTGGTCGTCGCGCTGAGAAAGTTTTCTGCCTCCTGAAGCGAATAAAGGGGCCG
CGCCCGGCCGCGGCGCGACTCGGCAAAAAAAAAAAAAAA

FIGURE 368

></usr/seqdb2/sst/DNA/Dnaseqs.min/ss.DNA76398

><subunit 1 of 1, 121 aa, 1 stop

><MW: 12073, pI: 4.11, NX(S/T): 0

MASCLALRMALLLVSGVLAPAVLTDDVPQEPVPTLWNEPAELPSGEGPVESTSPGREPVDTGP
PAPTVAPGPEDSTAQERLDQGGGSLGPGAIAAIVIAALLATCVVLALVVVALRKFSAS

Important features of the protein:

Signal peptide:

amino acids 1-19

Transmembrane domain:

amino acids 91-110

Glycosaminoglycan attachment site.

amino acids 44-47 cAMP- and cGMP-dependent protein kinase phosphorylation site.

amino acids 116-119

N-myristoylation site.

amino acids 91-96

FIGURE 369

GGCCGTTGGTTGGTGCGCGGCTGAAGGGTGTGGCGCGAGCAGCGTCGTTGGTTGGCCGGCGGC
GGGCCGGGACGGGCATGGCCCTGCTGCTGTGCCTGGTGTGCCTGACGGCGGCGCTGGCCCACG
GCTGTCTGCACTGCCACAGCAACTTCTCCAAGAAGTTCTCCTTCTACCGCCACCATGTGAACT
TCAAGTCCTGGTGGGTGGGCGACATCCCCGTGTCAGGGGCGCTGCTCACCGACTGGAGCGACG
ACACGATGAAGGAGCTGCACCTGGCCATCCCCGCCAAGATCACCCGGGAGAAGCTGGACCAAG
TGGCGACAGCAGTGTACCAGATGATGGATCAGCTGTACCAGGGGAAGATGTACTTCCCCGGGT
ATTTCCCCAACGAGCTGCGAAACATCTTCCGGGAGCAGGTGCACCTCATCCAGAACGCCATCA
TCGAAAGGCACCTGGCACCAGGCAGCTGGGGAGGAGGGCAGCTCTCCAGGGAGGGACCCAGCC
TAGCACCTGAAGGATCAATGCCATCACCCCGCGGGGACCTCCCCTAAGTAGCCCCCAGAGGCG
CTGGGAGTGTTGCCACCGCCCTCCCCTGAAGTTTGCTCCATCTCACGCTGGGGGTCAACCTGG
GGACCCCTTCCCTCCGGGCCATGGACACACATACATGAAAACCAGGCCGCATCGACTGTCAGC
ACCGCTGTGGCATCTTCCAGTACGAGACCATCTCCTGCAACAACTGCACAGACTCGCACGTCG
CCTGCTTTGGCTATAACTGCGAGTAGGGCTCAGGCATCACACCCACCCGTGCCAGGGCCCTAC
TGTCCCTGGGGTCCCAGGCTCTCCTTGGAGGGGGCTCCCCGCCTTCCACCTGGCTGTCATCGG
GTAGGGCGGGGCCGTGGGTTCAGGGGCGCACCACTTCCAAGCCTGTGTCCCACAGGTCCTCGG
CGCAGTGGAAGTCAGCTGTCCAGGGCCTCCTGAACTACATAAATAACTGGCACAAGTAAGTCC
CCTCCTCAAACCAACACAGGCAGTGTGTGTATGTGAGCACCTCGTGGGTGAGTATGTGTGGGG
CACAGGCTGGCTCCCTCAGCTCCCACGTCCTAGAGGGGCTCCCGAGGAGGTGGAACCTCAACC
CAGCTCTGCGCAGGAGGCGGCTGCAGTCCTTTTCTCCCTCAAAGGTCTCCGACCCTCAGCTGG
AGGCGGGCATCTTTCCTAAAGGGTCCCCATAGGGTCTGGTTCCACCCCATCCCAGGTCTGTGG
TCAGAGCCTGGGAGGGTTCCCTACGATGGTTAGGGGTGCCCCATGGAGGGGCTGACTGCCCCA
CATTGCCTTTCAGACAGGACACGAGCATGAGGTAAGGCCGCCCTGACCTGGACTTCAGGGGGA
GGGGGTAAAGGGAGAGAGGAGGGGGGCTAGGGGGTCCTCTAGATCAGTGGGGGCACTGCAGGT
GGGGCTCTCCCTATACCTGGGACACCTGCTGGATGTCACCTCTGCAACCACACCCATGTGGTG
GTTTCATGAACAGACCACGCTCCTCTGCCTTCTCCTGGCCTGGGACACACAGAGCCACCCCGG
CCTTGTGAGTGACCCAGAGAAGGGAGGCCTCGGGAGAAGGGGTGCTCGTAAGCCAACACCAGC
GTGCCGCGGCCTGCACACCCTTCGGACATCCCAGGCACGAGGGTGTCGTGGATGTGGCCACAC
ATAGGACCACACGTCCCAGCTGGGAGGAGAGGCCTGGGGCCCCCAGGGAGGGAGGCAGGGGGT
GGGGGACATGGAGAGCTGAGGCAGCCTCGTCTCCCCGCAGCCTGGTATCGCCAGCCTTAAGGT
GTCTGGAGCCCCCACACTTGGCCAACCTGACCTTGGAAGATGCTGCTGAGTGTCTCAAGCAGC
ACTGACAGCAGCTGGGCCTGCCCCAGGGCAACGTGGGGGCGGAGACTCAGCTGGACAGCCCCT
GCCTGTCACTCTGGAGCTGGGCTGCTGCTGCCTCAGGACCCCCTCTCCGACCCCGGACAGAGC
TGAGCTGGCCAGGGCCAGGAGGGCGGGAGGGAGGGAATGGGGGTGGGCTGTGCGCAGCATCAG
CGCCTGGGCAGGTCCGCAGAGCTGCGGGATGTGATTAAAGTCCCTGATGTTTCTC

FIGURE 370

></usr/seqdb2/sst/DNA/Dnaseqs.min/ss.DNA76399

><subunit 1 of 1, 157 aa, 1 stop

><MW: 17681, pI: 7.65, NX(S/T): 1

MALLLCLVCLTAALAHGCLHCHSNFSKKFSFYRHHVNFKSWWVGDIPVSGALLTDWSDDTMKE
LHLAIPAKITREKLDQVATAVYQMMDQLYQGKMYFPGYFPNELRNIFREQVHLIQNAIIERHL
APGSWGGGQLSREGPSLAPEGSMPSPRGDLP

Signal peptide:

amino acids 1-15

FIGURE 371

GCCGGCTGTGCAGAGACGCCATGTACCGGCTCCTGTCAGCAGTGACTGCCCGGGCTGCCGCCC
CCGGGGGCTTGGCCTCAAGCTGCGGACGACGCGGGGTCCATCAGCGCGCCGGGCTGCCGCCTC
TCGGCCACGGCTGGGTCGGGGGCCTCGGGCTGGGGCTGGGGCTGGCGCTCGGGGTGAAGCTGG
CAGGTGGGCTGAGGGGCGCGGCCCCGGCGCAGTCCCCCGCGGCCCCCGACCCTGAGGCGTCGC
CTCTGGCCGAGCCGCCACAGGAGCAGTCCCTCGCCCCGTGGTCTCCGCAGACCCCGGCGCCGC
CCTGCTCCAGGTGCTTCGCCAGAGCCATCGAGAGCAGCCGCGACCTGCTGCACAGGATCAAGG
ATGAGGTGGGCGCACCGGGCATAGTGGTTGGAGTTTCTGTAGATGGAAAAGAAGTCTGGTCAG
AAGGTTTAGGTTATGCTGATGTTGAGAACCGTGTACCATGTAAACCAGAGACAGTTATGCGAA
TTGCTAGCATCAGCAAAAGTCTCACCATGGTTGCTCTTGCCAAATTGTGGGAAGCAGGGAAAC
TGGATCTTGATATTCCAGTACAACATTATGTTCCCGAATTCCCAGAAAAAGAATATGAAGGTG
AAAAGGTTTCTGTCACAACAAGATTACTGATTTCCCATTTAAGTGGAATTCGTCATTATGAAA
AGGACATAAAAAAGGTGAAAGAAGAGAAAGCTTATAAAGCCTTGAAGATGATGAAAGAGAATG
TTGCATTTGAGCAAGAAAAAGAAGGCAAAAGTAATGAAAAGAATGATTTTACTAAATTTAAAA
CAGAGCAGGAGAATGAAGCCAAATGCCGGAATTCAAAACCTGGCAAGAAAAAGAATGATTTTG
AACAAGGCGAATTATATTTGAGAGAAAAGTTTGAAAATTCAATTGAATCCCTAAGATTATTTA
AAAATGATCCTTTGTTCTTCAAACCTGGTAGTCAGTTTTTGTATTCAACTTTTGGCTATACCC
TACTGGCAGCCATAGTAGAGAGAGCTTCAGGATGTAAATATTTGGACTATATGCAGAAAATAT
TCCATGACTTGGATATGCTGACGACTGTGCAGGAAGAAAACGAGCCAGTGATTTACAATAGAG
CAAGGTAAATGAATACCTTCTGCTGTGTCTAGCTATATCGCATCTTAACACTATTTTATTAAT
TAAAAGTCAAATTTTCTTTGTTTCCATTCCAAAATCAACCTGCCACATTTTGGGAGCTTTTCT
ACATGTCTGTTTTCTCATCTGTAAAGTGAAGGAAGTAAAACATGTTTATAAAGTAAAAAAA

FIGURE 372

></usr/seqdb2/sst/DNA/Dnaseqs.min/ss.DNA76522

><subunit 1 of 1, 373 aa, 1 stop

><MW: 41221, pI: 8.54, NX(S/T): 0

MYRLLSAVTARAAAPGGLASSCGRRGVHQRAGLPPLGHGWVGGLGLGLGLALGVKLAGGLRGA
APAQSPAAPDPEASPLAEPPQEQSLAPWSPQTPAPPCSRCFARAIESSRDLLHRIKDEVGAPG
IVVGVSVDGKEVWSEGLGYADVENRVPCKPETVMRIASISKSLTMVALAKLWEAGKLDLDIPV
QHYVPEFPEKEYEGEKVSVTTRLLISHLSGIRHYEKDIKKVKEEKAYKALKMMKENVAFEQEK
EGKSNEKNDFTKFKTEQENEAKCRNSKPGKKKNDFEQGELYLREKFENSIESLRLFKNDPLFF
KPGSQFLYSTFGYTLLAAIVERASGCKYLDYMQKIFHDLDMLTTVQEENEPVIYNRAR

Signal peptide:

amino acids 1-19

Transmembrane domain:

amino acids 39-60

FIGURE 373

GACTACGGGGAGAGAGAGGAGACCAGGACAGCTGCTGAGACCTCTAAGAAGTCCAGATACTAA
GAGCAAAGATGTTTCAAACTGGGGGCCTCATTGTCTTCTACGGGCTGTTAGCCCAGACCATGG
CCCAGTTTGGAGGCCTGCCCGTGCCCCTGGACCAGACCCTGCCCTTGAATGTGAATCCAGCCCTG
CCCTTGAGTCCCACAGGTCTTGCAGGAAGCTTGACAAATGCCCTCAGCAATGGCCTGCTGTCT
GGGGGCCTGTTGGGCATTCTGGAAAACCTTCCGCTCCTGGACATCCTGAAGCCTGGAGGAGGT
ACTTCTGGTGGCCTCCTTGGGGGACTGCTTGGAAAAGTGACGTCAGTGATTCCTGGCCTGAAC
AACATCATTGACATAAAGGTCACTGACCCCCAGCTGCTGGAACTTGGCCTTGTGCAGAGCCCT
GATGGCCACCGTCTCTATGTCACCATCCCTCTCGGCATAAAGCTCCAAGTGAATACGCCCCTG
GTCGGTGCAAGTCTGTTGAGGCTGGCTGTGAAGCTGGACATCACTGCAGAAATCTTAGCTGTG
AGAGATAAGCAGGAGAGGATCCACCTGGTCCTTGGTGACTGCACCCATTCCCCTGGAAGCCTG
CAAATTTCTCTGCTTGATGGACTTGGCCCCCTCCCCATTCAAGGTCTTCTGGACAGCCTCACA
GGGATCTTGAATAAAGTCCTGCCTGAGTTGGTTCAGGGCAACGTGTGCCCTCTGGTCAATGAG
GTTCTCAGAGGCTTGGACATCACCCTGGTGCATGACATTGTTAACATGCTGATCCACGGACTA
CAGTTTGTCATCAAGGTCTAAGCCTTCCAGGAAGGGGCTGGCCTCTGCTGAGCTGCTTCCCAG
TGCTCACAGATGGCTGGCCCATGTGCTGGAAGATGACACAGTTGCCTTCTCTCCGAGGAACCT
GCCCCCTCTCCTTTCCCACCAGGCGTGTGTAACATCCCATGTGCCTCACCTAATAAAATGGCT
CTTCTTATGCA

FIGURE 374

></usr/seqdb2/sst/DNA/Dnaseqs.min/ss.DNA76533
><subunit 1 of 1, 256 aa, 1 stop
><MW: 26713, pI: 5.62, NX(S/T): 0
MFQTGGLIVFYGLLAQTMAQFGGLPVPLDQTLPLNVNPALPLSPTGLAGSLTNALSNGLL
SGGLLGILENLPLLDILKPGGGTSGGLLGGLLGKVTSVIPGLNNIIDIKVTDPQLLELGL
VQSPDGHRLYVTIPLGIKLQVNTPLVGASLLRLAVKLDITAEILAVRDKQERIHLVLGDC
THSPGSLQISLLDGLGPLPIQGLLDSLTGILNKVLPELVQGNVCPLVNEVLRGLDITLVH
DIVNMLIHGLQFVIKV

Important features of the protein:

Signal peptide:

Amino acids 1-19

Transmembrane domain:

Amino acids 79-97

N-myristoylation sites:

Amino acids 46-52;49-55;58-64;62-68;66-72;80-86;81-87;
82-88;85-91;86-92;89-95;202-208;233-239

FIGURE 375

AGTTCTGAGAAAGAAGGAAATAAACACAGGCACCAAACCACTATCCTAAGTTGACTGTCCTTT
AAATATGTCAAGATCCAGACTTTTCAGTGTCACCTCAGCGATCTCAACGATAGGGATCTTGTG
TTTGCCGCTATTCCAGTTGGTGCTCTCGGACCTACCATGCGAAGAAGATGAAATGTGTGTAAA
TTATAATGACCAACACCCTAATGGCTGGTATATCTGGATCCTCCTGCTGCTGGTTTTGGTGGC
AGCTCTTCTCTGTGGAGCTGTGGTCCTCTGCCTCCAGTGCTGGCTGAGGAGACCCCGAATTGA
TTCTCACAGGCGCACCATGGCAGTTTTTGCTGTTGGAGACTTGGACTCTATTTATGGGACAGA
AGCAGCTGTGAGTCCAACTGTTGGAATTCACCTTCAAACTCAAACCCCTGACCTATATCCTGT
TCCTGCTCCATGTTTTGGCCCTTTAGGCTCCCCACCTCCATATGAAGAAATTGTAAAAACAAC
CTGATTTTAGGTGTGGATTATCAATTTAAAGTATTAACGACATCTGTAATTCCAAAACATCAA
ATTTAGGAATAGTTATTTCAGTTGTTGGAAATGTCCAGAGATCTATTCATATAGTCTGAGGAA
GGACAATTCGACAAAAGAATGGATGTTGGAAAAAATTTTGGTCATGGAGATGTTTAAATAGTA
AAGTAGCAGGCTTTTGATGTGTCACTGCTGTATCATACTTTTATGCTACACAACCAAATTAAT
GCTTCTCCACTAGTATCCAAACAGGCAACAATTAGGTGCTGGAAGTAGTTTCCATCACATTTA
GGACTCCACTGCAGTATACAGCACACCATTTTCTGCTTTAAACTCTTTCCTAGCATGGGGTCC
ATAAAAATTATTATAATTTAACAATAGCCCAAGCCGAGAATCCAACATGTCCAGAACCAGAAC
CAGAAAGATAGTATTTGAATGAAGGTGAGGGGAGAGAGTAGGAAAAAGAAAAGTTTGGAGTTG
AAGGGTAAAGGATAAATGAAGAGGAAAAGGAAAAGATTACAAGTCTCAGCAAAAACAAGAGGT
TTTATGCCCCAACCTGAAGAGGAAGAAATTGTAGATAGAAGGTGAAGGAGATTGCTGAAGATA
TAGAGCACATATAATGCCAACACGGGGAGAAAAGAAAATTTCCCCTTTTACAGTAATGAATGT
GGCCTCCATAGTCCATAGTGTTTCTCTGGAGCCTCAGGGCTTGGCATTTATTGCAGCATCATG
CTAAGAACCTTCGGCATAGGTATCTGTTCCCATGAGGACTGCAGAAGTAGCAATGAGACATCT
TCAAGTGGCATTTTGGCAGTGGCCATCAGCAGGGGGACAGACAAAAACATCCATCACAGATGA
CATATGATCTTCAGCTGACAAATTTGTTGAACAAAACAATAAACATCAATAGATATCTAAAAA

FIGURE 376

></usr/seqdb2/sst/DNA/Dnaseqs.min/ss.DNA77303

><subunit 1 of 1, 146 aa, 1 stop

><MW: 16116, pI: 4.99, NX(S/T): 0

MSRSRLFSVTSAISTIGILCLPLFQLVLSDLPCEEDEMCVNYNDQHPNGWYIWILLLLVLVAA
LLCGAVVLCLQCWLRRPRIDSHRRTMAVFAVGDLDSIYGTEAAVSPTVGIHLQTQTPDLYPVP
APCFGPLGSPPPYEEIVKTT

Signal peptide:

amino acids 1-29

Transmembrane domain:

amino acids 52-70

FIGURE 377

CGCGGATCGGACCCAAGCAGGTCGGCGGCGGCGGCAGGAGAGCGGCCGGGCGTCAGCTCCTCG
ACCCCCGTGTCGGGCTAGTCCAGCGAGGCGGACGGGCGGCGTGGGCCCATGGCCAGGCCCGGC
ATGGAGCGGTGGCGCGACCGGCTGGCGCTGGTGACGGGGGCCTCGGGGGGCATCGGCGCGGCC
GTGGCCCGGGCCCTGGTCCAGCAGGGACTGAAGGTGGTGGGCTGCGCCCGCACTGTGGGCAAC
ATCGAGGAGCTGGCTGCTGAATGTAAGAGTGCAGGCTACCCCGGGACTTTGATCCCCTACAGA
TGTGACCTATCAAATGAAGAGGACATCCTCTCCATGTTCTCAGCTATCCGTTCTCAGCACAGC
GGTGTAGACATCTGCATCAACAATGCTGGCTTGGCCCGGCCTGACACCCTGCTCTCAGGCAGC
ACCAGTGGTTGGAAGGACATGTTCAATGTGAACGTGCTGGCCCTCAGCATCTGCACACGGGAA
GCCTACCAGTCCATGAAGGAGCGGAATGTGGACGATGGGCACATCATTAACATCAATAGCATG
TCTGGCCACCGAGTGTTACCCCTGTCTGTGACCCACTTCTATAGTGCCACCAAGTATGCCGTC
ACTGCGCTGACAGAGGGACTGAGGCAAGAGCTTCGGGAGGCCCAGACCCACATCCGAGCCACG
TGCATCTCTCCAGGTGTGGTGGAGACACAATTCGCCTTCAAACTCCACGACAAGGACCCTGAG
AAGGCAGCTGCCACCTATGAGCAAATGAAGTGTCTCAAACCCGAGGATGTGGCCGAGGCTGTT
ATCTACGTCCTCAGCACCCCCGCACACATCCAGATTGGAGACATCCAGATGAGGCCCACGGAG
CAGGTGACCTAGTGACTGTGGGAGCTCCTCCTTCCCTCCCCACCCTTCATGGCTTGCCTCCTG
CCTCTGGATTTTAGGTGTTGATTTCTGGATCACGGGATACCACTTCCTGTCCACACCCCGACC
AGGGGCTAGAAAATTTGTTTGAGATTTTTATATCATCTTGTCAAATTGCTTCAGTTGTAAATG
TGAAAAATGGGCTGGGGAAAGGAGGTGGTGTCCCTAATTGTTTTACTTGTTAACTTGTTCTTG
TGCCCCTGGGCACTTGGCCTTTGTCTGCTCTCAGTGTCTTCCCTTTGACATGGGAAAGGAGTT
GTGGCCAAAATCCCCATCTTCTTGCACCTCAACGTCTGTGGCTCAGGGCTGGGGTGGCAGAGG
GAGGCCTTCACCTTATATCTGTGTTGTTATCCAGGGCTCCAGACTTCCTCCTCTGCCTGCCCC
ACTGCACCCTCTCCCCCTTATCTATCTCCTTCTCGGCTCCCCAGCCCAGTCTTGGCTTCTTGT
CCCCTCCTGGGGTCATCCCTCCACTCTGACTCTGACTATGGCAGCAGAACACCAGGGCCTGGC
CCAGTGGATTTCATGGTGATCATTAAAAAAGAAAAATCGCAACCAAAAAAAAAAAA

FIGURE 378

MARPGMERWRDRLALVTGASGGIGAAVARALVQQGLKVVGCARTVGNIEELAAECKSAGYPGT
LIPYRCDLSNEEDILSMFSAIRSQHSGVDICINNAGLARPDTLLSGSTSGWKDMFNVNVLALS
ICTREAYQSMKERNVDDGHIININSMSGHRVLPLSVTHFYSATKYAVTALTEGLRQELREAQT
HIRATCISPGVVETQFAFKLHDKDPEKAAATYEQMKCLKPEDVAEAVIYVLSTPAHIQIGDIQ
MRPTEQVT

Important features of the protein:

Signal peptide:

amino acids 1-17

N-myristoylation sites.

amino acids 18-24, 21-27, 22-28, 24-30, 40-46, 90-96, 109-115, 199-205

Short-chain alcohol dehyrogenase.

amino acids 30-42, 104-114

FIGURE 379

GAGCGGAGTAAAATCTCCACAAGCTGGGAACAAACCTCGTCCCAACTCCCACCCACCGGCGTT
TCTCCAGCTCGATCTGGAGGCTGCTTCGCCAGTGTGGGACGCAGCTGACGCCCGCTTATTAGC
TCTCGCTGCGTCGCCCCGGCTCAGAAGCTCCGTGGCGGCGGCGACCGTGACGAGAAGCCCACG
GCCAGCTCAGTTCTCTTCTACTTTGGGAGAGAGAGAAAGTCAGATGCCCCTTTTAAACTCCCT
CTTCAAAACTCATCTCCTGGGTGACTGAGTTAATAGAGTGGATACAACCTTGCTGAAGATGAA
GAATATACAATATTGAGGATATTTTTTTCTTTTTTTTTTCAAGTCTTGATTTGTGGCTTACCT
CAAGTTACCATTTTTCAGTCAAGTCTGTTTGTTTGCTTCTTCAGAAATGTTTTTTACAATCTC
AAGAAAAAAATATGTCCCAGAAATTGAGTTTACTGTTGCTTGTATTTGGACTCATTTGGGGATT
GATGTTACTGCACTATACTTTTCAACAACCAAGACATCAAAGCAGTGTCAAGTTACGTGAGCA
AATACTAGACTTAAGCAAAAGATATGTTAAAGCTCTAGCAGAGGAAAATAAGAACACAGTGGA
TGTCGAGAACGGTGCTTCTATGGCAGGATATGCGGATCTGAAAAGAACAATTGCTGTCCTTCT
GGATGACATTTTGCAACGATTGGTGAAGCTGGAGAACAAAGTTGACTATATTGTTGTGAATGG
CTCAGCAGCCAACACCACCAATGGTACTAGTGGGAATTTGGTGCCAGTAACCACAAATAAAAG
AACGAATGTCTCGGGCAGTATCAGATAGCAGTTGAAAATCACCTTGTGCTGCTCCATCCACTG
TGGATTATATCCTATGGCAGAAAAGCTTTATAATTGCTGGCTTAGGACAGAGCAATACTTTAC
AATAAAAGCTCTACACATTTTCAAGGAGTATGCTGGATTCATGGAACTCTAATTCTGTACATA
AAAATTTTAAAGTTATTGTTTGCTTTCAGGCAAGTCTGTTCAATGCTGTACTATGTCCTTAA
AGAGAATTTGGTAACTTGGTTGATGTGGTAAGCAGATAGGTGAGTTTTGTATAAATCTTTTGT
GTTTGAGATCAAGCTGAAATGAAAACACTGAAAAACATGGATTCATTTCTATAACACATTTAT
TTAAGTATATAACACGTTTTTTGGACAAGTGAAGAATGTTTAATCATTCTGTCATTTGTTCTC
AATAGATGTAACTGTTAGACTACGGCTATTTGAAAAAATGTGCTTATTGTACTATATTTTGTT
ATTCCAATTATGAGCAGAGAAAGGAAATATAATGTTGAAAATAATGTTTTGAAATCATGACCC
AAAGAATGTATTGATTTGCACTATCCTTCAGAATAACTGAAGGTTAATTATTGTATATTTTTA
AAAATTACACTTATAAGAGTATAATCTTGAAATGGGTAGCAGCCACTGTCCATTACCTATCGT
AAACATTGGGGCAATTTAATAACAGCATTAAAATAGTTGTAAACTCTAATCTTATACTTATTG
AAGAATAAAAGATATTTTTATGATGAGAGTAACAATAAAGTATTCATGATTTTTCACATACAT
GAATGTTCATTTAAAAGTTTAATCCTTTGAGTGTCTATGCTATCAGGAAAGCACATTATTTCC
ATATTTGGGTTAATTTTGCTTTTATTATATTGGTCTAGGAGGAAGGGACTTTGGAGAATGGAA
CTCTTGAGGACTTTAGCCAGGTGTATATAATAAAGGTACTTTTGTGCTGCATTAAATTGCTTG
GAAAGTGTTAACATTATATTATATAAGAGTATCCTTTATGAAATTTTGAATTTGTATAACAGA
TGCATTAGATATTCATTTTATATAATGGCCACTTAAAATAAGAACATTTAAAATATAAACTAT
GAAGATTGACTATCTTTTCAGGAAAAAAGCTGTATATAGCACAGGGAACCCTAATCTTGGGTA
ATTCTAGTATAAAACAAATTATACTTTTATTTAAATTTCCCTTGTAGCAAATCTAATTGCCAC
ATGGTGCCCTATATTTCATAGTATTTATTCTCTATAGTAACTGCTTAAGTGCAGCTAGCTTCT
AGATTTAGACTATATAGAATTTAGATATTGTATTGTTCGTCATTATAATATGCTACCACATGT
AGCAATAATTACAATATTTTATTAAAATAAATATGTGAAATATTGTTTCATGAAAGACAGATT
TCCAAATCTCTCTTCTCTTCTCTGTACTGTCTACCTTTATGTGAAGAAATTAATTATATGCCA
TTGCCAGGT

FIGURE 380

></usr/seqdb2/sst/DNA/Dnaseqs.min/ss.DNA77648

><subunit 1 of 1, 140 aa, 1 stop

><MW: 15668, pI: 10.14, NX(S/T): 5

MFFTISRKNMSQKLSLLLLVFGLIWGLMLLHYTFQQPRHQSSVKLREQILDLSKRYVKALAEE
NKNTVDVENGASMAGYADLKRTIAVLLDDILQRLVKLENKVDYIVVNGSAANTTNGTSGNLVP
VTTNKRTNVSGSIR

Important features of the protein:

Signal peptide:

amino acids 1-26

FIGURE 381

AACTTCTACATGGGCCTCCTGCTGCTGGTGCTCTTCCTCAGCCTCCTGCCGGTGGCCTACACC
ATCATGTCCCTCCCACCCTCCTTTGACTGCGGGCCGTTCAGGTGCAGAGTCTCAGTTGCCCGG
GAGCACCTCCCCTCCCGAGGCAGTCTGCTCAGAGGGCCTCGGCCCAGAATTCCAGTTCTGGTT
TCATGCCAGCCTGTAAAAGGCCATGGAACTTTGGGTGAATCACCGATGCCATTTAAGAGGGTT
TTCTGCCAGGATGGAAATGTTAGGTCGTTCTGTGTCTGCGCTGTTCATTTCAGTAGCCACCAG
CCACCTGTGGCCGTTGAGTGCTTGAAATGAGGAACTGAGAAAATTAATTTCTCATGTATTTTT
CTCATTTATTTATTAATTTTTAACTGATAGTTGTACATATTTGGGGGTACATGTGATATTTGG
ATACATGTATACAATATATAATGATCAAATCAGGGTAACTGGGATATCCATCACATCAAACAT
TTATTTTTTATTCTTTTTAGACAGAGTCTCACTCTGTCACCCAGGCTGGAGTGCAGTGGTGCC
ATCTCAGCTTACTGCAACCTCTGCCTGCCAGGTTCAAGCGATTCTCATGCCTCCACCTCCCAA
GTAGCTGGGACTACAGGCATGCACCACAATGCCCAACTAATTTTTGTATTTTTAGTAGAGACG
GGGTTTTGCCATGTTGCCCAGGCTGGCCTTGAACTCCTGGCCTCAAACAATCCACTTGCCTCG
GCCTCCCAAAGTGTTATGATTACAGGCGTGAGCCACCGTGCCTGGCCTAAACATTTATCTTTT
CTTTGTGTTGGGAACTTTGAAATTATACAATGAATTATTGTTAACTGTCATCTCCCTGCTGTG
CTATGGAACACTGGGACTTCTTCCCTCTATCTAACTGTATATTTGTACCAGTTAACCAACCGT
ACTTCATCCCCACTCCTCTCTATCCTTCCCAACCTCTGATCACCTCATTCTACTCTCTACCTC
CATGAGATCCACTTTTTTAGCTCCCACATGTGAGTAAGAAAATGCAATATTTGTCTTTCTGTG
CCTGGCTTATTTCACTTAACATAATGACTTCCTGTTCCATCCATGTTGCTGCAAATGACAGGA
TTTCGTTCTTAATTTCAATTAAAATAACCACACATGGCAAAAA

FIGURE 382

MGLLLLVLFLSLLPVAYTIMSLPPSFDCGPFRCRVSVAREHLPSRGSLLRGPRPRIPVLVSCQ
PVKGHGTLGESPMPFKRVFCQDGNVRSFCVCAVHFSSHQPPVAVECLK

Important features of the protein:

Signal peptide:

amino acids 1-18

N-myristoylation site.

amino acids 86-92

Zinc carboxypeptidases, zinc-binding region 2 signature.

amino acids 68-79

FIGURE 383

TTCTGAAGTAACGGAAGCTACCTTGTATAAAGACCTCAACACTGCTGACCATGATCAGCGCAG
CCTGGAGCATCTTCCTCATCGGGACTAAAATTGGGCTGTTCCTTCAAGTAGCACCTCTATCAG
TTATGGCTAAATCCTGTCCATCTGTGTGTCGCTGCGATGCGGGTTTCATTTACTGTAATGATC
GCTTTCTGACATCCATTCCAACAGGAATACCAGAGGATGCTACAACTCTCTACCTTCAGAACA
ACCAAATAAATAATGCTGGGATTCCTTCAGATTTGAAAAACTTGCTGAAAGTAGAAAGAATAT
ACCTATACCACAACAGTTTAGATGAATTTCCTACCAACCTCCCAAAGTATGTAAAAGAGTTAC
ATTTGCAAGAAAATAACATAAGGACTATCACTTATGATTCACTTTCAAAAATTCCCTATCTGG
AAGAATTACATTTAGATGACAACTCTGTCTCTGCAGTTAGCATAGAAGAGGGAGCATTCCGAG
ACAGCAACTATCTCCGACTGCTTTTCCTGTCCCGTAATCACCTTAGCACAATTCCCTGGGGTT
TGCCCAGGACTATAGAAGAACTACGCTTGGATGATAATCGCATATCCACTATTTCATCACCAT
CTCTTCAAGGTCTCACTAGTCTAAAACGCCTGGTTCTAGATGGAAACCTGTTGAACAATCATG
GTTTAGGTGACAAAGTTTTCTTCAACCTAGTTAATTTGACAGAGCTGTCCCTGGTGCGGAATT
CCCTGACTGCTGCACCAGTAAACCTTCCAGGCACAAACCTGAGGAAGCTTTATCTTCAAGATA
ACCACATCAATCGGGTGCCCCCAAATGCTTTTTCTTATCTAAGGCAGCTCTATCGACTGGATA
TGTCCAATAATAACCTAAGTAATTTACCTCAGGGTATCTTTGATGATTTGGACAATATAACAC
AACTGATTCTTCGCAACAATCCCTGGTATTGCGGGTGCAAGATGAAATGGGTACGTGACTGGT
TACAATCACTACCTGTGAAGGTCAACGTGCGTGGGCTCATGTGCCAAGCCCCAGAAAAGGTTC
GTGGGATGGCTATTAAGGATCTCAATGCAGAACTGTTTGATTGTAAGGACAGTGGGATTGTAA
GCACCATTCAGATAACCACTGCAATACCCAACACAGTGTATCCTGCCCAAGGACAGTGGCCAG
CTCCAGTGACCAAACAGCCAGATATTAAGAACCCCAAGCTCACTAAGGATCAACAAACCACAG
GGAGTCCCTCAAGAAAAACAATTACAATTACTGTGAAGTCTGTCACCTCTGATACCATTCATA
TCTCTTGGAAACTTGCTCTACCTATGACTGCTTTGAGACTCAGCTGGCTTAAACTGGGCCATA
GCCCGGCATTTGGATCTATAACAGAAACAATTGTAACAGGGGAACGCAGTGAGTACTTGGTCA
CAGCCCTGGAGCCTGATTCACCCTATAAAGTATGCATGGTTCCCATGGAAACCAGCAACCTCT
ACCTATTTGATGAAACTCCTGTTTGTATTGAGACTGAAACTGCACCCCTTCGAATGTACAACC
CTACAACCACCCTCAATCGAGAGCAAGAGAAAGAACCTTACAAAAACCCCAATTTACCTTTGG
CTGCCATCATTGGTGGGGCTGTGGCCCTGGTTACCATTGCCCTTCTTGCTTTAGTGTGTTGGT
ATGTTCATAGGAATGGATCGCTCTTCTCAAGGAACTGTGCATATAGCAAAGGGAGGAGAAGAA
AGGATGACTATGCAGAAGCTGGCACTAAGAAGGACAACTCTATCCTGGAAATCAGGGAAACTT
CTTTTCAGATGTTACCAATAAGCAATGAACCCATCTCGAAGGAGGAGTTTGTAATACACACCA
TATTTCCTCCTAATGGAATGAATCTGTACAAAAACAATCACAGTGAAAGCAGTAGTAACCGAA
GCTACAGAGACAGTGGTATTCCAGACTCAGATCACTCACACTCATGATGCTGAAGGACTCACA
GCAGACTTGTGTTTTGGGTTTTTAAACCTAAGGGAGGTGATGGT

FIGURE 384

MISAAWSIFLIGTKIGLFLQVAPLSVMAKSCPSVCRCDAGFIYCNDRFLTSIPTGIPEDATTL
YLQNNQINNAGIPSDLKNLLKVERIYLYHNSLDEFPTNLPKYVKELHLQENNIRTITYDSLSK
IPYLEELHLDDNSVSAVSIEEGAFRDSNYLRLLFLSRNHLSTIPWGLPRTIEELRLDDNRIST
ISSPSLQGLTSLKRLVLDGNLLNNHGLGDKVFFNLVNLTELSLVRNSLTAAPVNLPGTNLRKL
YLQDNHINRVPPNAFSYLRQLYRLDMSNNNLSNLPQGIFDDLDNITQLILRNNPWYCGCKMKW
VRDWLQSLPVKVNVRGLMCQAPEKVRGMAIKDLNAELFDCKDSGIVSTIQITTAIPNTVYPAQ
GQWPAPVTKQPDIKNPKLTKDQQTTGSPSRKTITITVKSVTSDTIHISWKLALPMTALRLSWL
KLGHSPAFGSITETIVTGERSEYLVTALEPDSPYKVCMVPMETSNLYLFDETPVCIETETAPL
RMYNPTTTLNREQEKEPYKNPNLPLAAIIGGAVALVTIALLALVCWYVHRNGSLFSRNCAYSK
GRRRKDDYAEAGTKKDNSILEIRETSFQMLPISNEPISKEEFVIHTIFPPNGMNLYKNNHSES
SSNRSYRDSGIPDSDHSHS

Important features of the protein:
Signal peptide:
amino acids 1-28
Transmembrane domain:
amino acids 531-552
N-glycosylation sites.
amino acids 226-229, 282-285, 296-299, 555-558, 626-629, 633-636
Tyrosine kinase phosphorylation site.
amino acids 515-522
N-myristoylation sites.
amino acids 12-17, 172-177, 208-213, 359-364, 534-539, 556-561, 640-645
Amidation site.
amino acids 567-570
Leucine zipper pattern.
amino acids 159-180
Phospholipase A2 aspartic acid active site.
amino acids 34-44

FIGURE 385

CCGTCATCCCCCTGCAGCCACCCTTCCCAGAGTCCTTTGCCCAGGCCACCCCAGGCTTCTTGG
CAGCCCTGCCGGGCCACTTGTCTTCATGTCTGCCAGGGGGAGGTGGGAAGGAGGTGGGAGGAG
GGCGTGCAGAGGCAGTCTGGGCTTGGCCAGAGCTCAGGGTGCTGAGCGTGTGACCAGCAGTGA
GCAGAGGCCGGCCATGGCCAGCCTGGGGCTGCTGCTCCTGCTCTTACTGACAGCACTGCCACC
GCTGTGGTCCTCCTCACTGCCTGGGCTGGACACTGCTGAAAGTAAAGCCACCATTGCAGACCT
GATCCTGTCTGCGCTGGAGAGAGCCACCGTCTTCCTAGAACAGAGGCTGCCTGAAATCAACCT
GGATGGCATGGTGGGGGTCCGAGTGCTGGAAGAGCAGCTAAAAAGTGTCCGGGAGAAGTGGGC
CCAGGAGCCCCTGCTGCAGCCGCTGAGCCTGCGCGTGGGGATGCTGGGGGAGAAGCTGGAGGC
TGCCATCCAGAGATCCCTCCACTACCTCAAGCTGAGTGATCCCAAGTACCTAAGAGAGTTCCA
GCTGACCCTCCAGCCCGGGTTTTGGAAGCTCCCACATGCCTGGATCCACACTGATGCCTCCTT
GGTGTACCCCACGTTCGGGCCCCAGGACTCATTCTCAGAGGAGAGAAGTGACGTGTGCCTGGT
GCAGCTGCTGGGAACCGGGACGGACAGCAGCGAGCCCTGCGGCCTCTCAGACCTCTGCAGGAG
CCTCATGACCAAGCCCGGCTGCTCAGGCTACTGCCTGTCCCACCAACTGCTCTTCTTCCTCTG
GGCCAGAATGAGGGGATGCACACAGGGACCACTCCAACAGAGCCAGGACTATATCAACCTCTT
CTGCGCCAACATGATGGACTTGAACCGCAGAGCTGAGGCCATCGGATACGCCTACCCTACCCG
GGACATCTTCATGGAAAACATCATGTTCTGTGGAATGGGCGGCTTCTCCGACTTCTACAAGCT
CCGGTGGCTGGAGGCCATTCTCAGCTGGCAGAAACAGCAGGAAGGATGCTTCGGGGAGCCTGA
TGCTGAAGATGAAGAATTATCTAAAGCTATTCAATATCAGCAGCATTTTTCGAGGAGAGTGAA
GAGGCGAGAAAAACAATTTCCAGATTCTCGCTCTGTTGCTCAGGCTGGAGTACAGTGGCGCAA
TCTCGGCTCACTGCAACCTTTGCCTCCTGGGTTCAAGCAATTCTCTTGCCTCATCCTCCCGAG
TAGCTGGGACTACAGGAGCGTGCCACCATACCTGGCTAATTTTTATATTTTTTTAGTAGAGAC
AGGGTTTCATCATGTTGCTCATGCTGGTCTCGAACTCCTGATCTCAAGAGATCCGCCCACCTC
AGGCTCCCAAAGTGTGGGATTATAGGTGTGAGCCACCGTGTCTGGCTGAAAAGCACTTTCAAA
GAGACTGTGTTGAATAAAGGGCCAAGGTTCTTGCCACCCAGCACTCATGGGGGCTCTCTCCCC
TAGATGGCTGCTCCTCCCACAACACAGCCACAGCAGTGGCAGCCCTGGGTGGCTTCCTATACA
TCCTGGCAGAATACCCCCCAGCAAACAGAGAGCCACACCCATCCACACCGCCACCACCAAGCA
GCCGCTGAGACGGACGGTTCCATGCCAGCTGCCTGGAGGAGGAACAGACCCCTTTAGTCCTCA
TCCCTTAGATCCTGGAGGGCACGGATCACATCCTGGGAAGAAGGCATCTGGAGGATAAGCAAA
GCCACCCCGACACCCAATCTTGGAAGCCCTGAGTAGGCAGGGCCAGGGTAGGTGGGGGCCGGG
AGGGACCCAGGTGTGAACGGATGAATAAAGTTCAACTGCAACTGAAAAAAAAAAA

FIGURE 386

MSARGRWEGGGRRACRGSLGLARAQGAERVTSSEQRPAMASLGLLLLLLLTALPPLWSSSLPG
LDTAESKATIADLILSALERATVFLEQRLPEINLDGMVGVRVLEEQLKSVREKWAQEPLLQPL
SLRVGMLGEKLEAAIQRSLHYLKLSDPKYLREFQLTLQPGFWKLPHAWIHTDASLVYPTFGPQ
DSFSEERSDVCLVQLLGTGTDSSEPCGLSDLCRSLMTKPGCSGYCLSHQLLFFLWARMRGCTQ
GPLQQSQDYINLFCANMMDLNRRAEAIGYAYPTRDIFMENIMFCGMGGFSDFYKLRWLEAILS
WQKQQEGCFGEPDAEDEELSKAIQYQQHFSRRVKRREKQFPDSRSVAQAGVQWRNLGSLQPLP
PGFKQFSCLILPSSWDYRSVPPYLANFYIFLVETGFHHVAHAGLELLISRDPPTSGSQSVGL

Important features of the protein:
Signal peptide:
amino acids 1-26

Transmembrane domain:
amino acids 39-56

Tyrosine kinase phosphorylation sites.
amino acids 149-156, 274-282

N-myristoylation sites.
amino acids 10-16, 20-26, 63-69, 208-214

Amidation site.
amino acids 10-14

Glycoprotein hormones beta chain signature 1.
amino acids 230-237

FIGURE 387

GGTCTGAGTGCAGAGCTGCTGTCATGGCGGCCGCTCTGTGGGGCTTCTTTCCCGTCCTGCTGC
TGCTGCTGCTATCGGGGGATGTCCAGAGCTCGGAGGTGCCCGGGGCTGCTGCTGAGGGATCGG
GAGGGAGTGGGGTCGGCATAGGAGATCGCTTCAAGATTGAGGGGCGTGCAGTTGTTCCAGGGG
TGAAGCCTCAGGACTGGATCTCGGCGGCCCGAGTGCTGGTAGACGGAGAAGAGCACGTCGGTT
TCCTTAAGACAGATGGGAGTTTTGTGGTTCATGATATACCTTCTGGATCTTATGTAGTGGAAG
TTGTATCTCCAGCTTACAGATTTGATCCCGTTCGAGTGGATATCACTTCGAAAGGAAAAATGA
GAGCAAGATATGTGAATTACATCAAAACATCAGAGGTTGTCAGACTGCCCTATCCTCTCCAAA
TGAAATCTTCAGGTCCACCTTCTTACTTTATTAAAAGGGAATCGTGGGGCTGGACAGACTTTC
TAATGAACCCAATGGTTATGATGATGGTTCTTCCTTTATTGATATTTGTGCTTCTGCCTAAAG
TGGTCAACACAAGTGATCCTGACATGAGACGGGAAATGGAGCAGTCAATGAATATGCTGAATT
CCAACCATGAGTTGCCTGATGTTTCTGAGTTCATGACAAGACTCTTCTCTTCAAAATCATCTG
GCAAATCTAGCAGCGGCAGCAGTAAAACAGGCAAAAGTGGGGCTGGCAAAAGGAGGTAGTCAG
GCCGTCCAGAGCTGGCATTTGCACAAACACGGCAACACTGGGTGGCATCCAAGTCTTGGAAAA
CCGTGTGAAGCAACTACTATAAACTTGAGTCATCCCGACGTTGATCTCTTACAACTGTGTATGTT
AACTTTTTAGCACATGTTTTGTACTTGGTACACGAGAAAACCCAGCTTTCATCTTTTGTCTGT
ATGAGGTCAATATTGATGTCACTGAATTAATTACAGTGTCCTATAGAAAATGCCATTAATAAA
TTATATGAACTACTATACATTATGTATATTAATTAAAACATCTTAATCCAGAAATCAAAAAAA
AAAAAAAAAAAAAAAAAAAA

FIGURE 388

MAAALWGFFPVLLLLLLSGDVQSSEVPGAAAEGSGGSGVGIGDRFKIEGRAVVPGVKPQDWIS
AARVLVDGEEHVGFLKTDGSFVVHDIPSGSYVVEVVSPAYRFDPVRVDITSKGKMRARYVNYI
KTSEVVRLPYPLQMKSSGPPSYFIKRESWGWTDFLMNPMVMMMVLPLLIFVLLPKVVNTSDPD
MRREMEQSMNMLNSNHELPDVSEFMTRLFSSKSSGKSSSGSSKTGKSGAGKRR

Important features of the protein:
Signal sequence:
amino acids 1-23

Transmembrane domain:
amino acids 161-182

N-glycosylation site.
amino acids 184-187

Glycosaminoglycan attachment sites.
amino acids 37-40, 236-239 cAMP- and cGMP-dependent protein kinase phosphorylation site.
amino acids 151-154

N-myristoylation sites.
amino acids 33-38, 36-41, 38-44, 229-234

Amidation site.
amino acids 238-241

ATP/GTP-binding site motif A (P-loop).
amino acids 229-236

FIGURE 389

GTCGTGTGCTTGGAGGAAGCCGCGGAACCCCCAGCGTCCGTCCATGGCGTGGAGCCTTGGGAG
CTGGCTGGGTGGCTGCCTGCTGGTGTCAGCATTGGGAATGGTACCACCTCCCGAAAATGTCAG
AATGAATTCTGTTAATTTCAAGAACATTCTACAGTGGGAGTCACCTGCTTTTGCCAAAGGGAA
CCTGACTTTCACAGCTCAGTACCTAAGTTATAGGATATTCCAAGATAAATGCATGAATACTAC
CTTGACGGAATGTGATTTCTCAAGTCTTTCCAAGTATGGTGACCACACCTTGAGAGTCAGGGC
TGAATTTGCAGATGAGCATTCAGACTGGGTAAACATCACCTTCTGTCCTGTGGATGACACCAT
TATTGGACCCCCTGGAATGCAAGTAGAAGTACTTGCTGATTCTTTACATATGCGTTTCTTAGC
CCCTAAAATTGAGAATGAATACGAAACTTGGACTATGAAGAATGTGTATAACTCATGGACTTA
TAATGTGCAATACTGGAAAAACGGTACTGATGAAAAGTTTCAAATTACTCCCCAGTATGACTT
TGAGGTCCTCAGAAACCTGGAGCCATGGACAACTTATTGTGTTCAAGTTCGAGGGTTTCTTCC
TGATCGGAACAAAGCTGGGGAATGGAGTGAGCCTGTCTGTGAGCAAACAACCCATGACGAAAC
GGTCCCCTCCTGGATGGTGGCCGTCATCCTCATGGCCTCGGTCTTCATGGTCTGCCTGGCACT
CCTCGGCTGCTTCTCCTTGCTGTGGTGCGTTTACAAGAAGACAAAGTACGCCTTCTCCCCTAG
GAATTCTCTTCCACAGCACCTGAAAGAGTTTTTGGGCCATCCTCATCATAACACACTTCTGTT
TTTCTCCTTTCCATTGTCGGATGAGAATGATGTTTTTGACAAGCTAAGTGTCATTGCAGAAGA
CTCTGAGAGCGGCAAGCAGAATCCTGGTGACAGCTGCAGCCTCGGGACCCCGCCTGGGCAGGG
GCCCCAAAGCTAGGCTCTGAGAAGGAAACACACTCGGCTGGGCACAGTGACGTACTCCATCTC
ACATCTGCCTCAGTGAGGGATCAGGGCAGCAAACAAGGGCCAAGACCATCTGAGCCAGCCCCA
CATCTAGAACTCCAGACCTGGACTTAGCCACCAGAGAGCTACATTTTAAAGGCTGTCTTGGCA
AAAATACTCCATTTGGGAACTCACTGCCTTATAAAGGCTTTCATGATGTTTTCAGAAGTTGGC
CACTGAGAGTGTAATTTTCAGCCTTTTATATCACTAAAATAAGATCATGTTTTAATTGTGAGA
AACAGGGCCGAGCACAGTGGCTCACGCCTGTAATACCAGCACCTTAGAGGTCGAGGCAGGCGG
ATCACTTGAGGTCAGGAGTTCAAGACCAGCCTGGCCAATATGGTGAAACCCAGTCTCTACTAA
AAATACAAAAATTAGCTAGGCATGATGGCGCATGCCTATAATCCCAGCTACTCGAGTGCCTGA
GGCAGGAGAATTGCATGAACCCGGGAGGAGGAGGAGGAGGTTGCAGTGAGCCGAGATAGCGGC
ACTGCACTCCAGCCTGGGTGACAAAGTGAGACTCCATCTCAAAAAAAAAAAAAAAAAATTGTG
AGAAACAGAAATACTTAAAATGAGGAATAAGAATGGAGATGTTACATCTGGTAGATGTAACAT
TCTACCAGATTATGGATGGACTGATCTGAAAATCGACCTCAACTCAAGGGTGGTCAGCTCAAT
GCTACACAGAGCACGGACTTTTGGATTCTTTGCAGTACTTTGAATTTATTTTTCTACCTATAT
ATGTTTTATATGCTGCTGGTGCTCCATTAAAGTTTTACTCTGTGTTGC

FIGURE 390

></usr/seqdb2/sst/DNA/Dnaseqs.min/ss.DNA83551
><subunit 1 of 1, 325 aa, 1 stop
><MW: 37011, pI: 5.09, NX(S/T): 4
MAWSLGSWLGGCLLVSALGMVPPPENVRMNSVNFKNILQWESPAFAKGNLTFTAQYLSYRIFQ
DKCMNTTLTECDFSSLSKYGDHTLRVRAEFADEHSDWVNITFCPVDDTIIGPPGMQVEVLADS
LHMRFLAPKIENEYETWTMKNVYNSWTYNVQYWKNGTDEKFQITPQYDFEVLRNLEPWTTYCV
QVRGFLPDRNKAGEWSEPVCEQTTHDETVPSWMVAVILMASVFMVCLALLGCFSLLWCVYKKT
KYAFSPRNSLPQHLKEFLGHPHHNTLLFFSFPLSDENDVFDKLSVIAEDSESGKQNPGDSCSL
GTPPGQGPQS

Important features of the protein:
Signal peptide:
amino acids 1-19

Transmembrane domain:
amino acids 222-245

N-glycosylation sites.
amino acids 49-53, 68-72, 102-106, 161-165

N-myristoylation sites.
amino acids 6-12, 316-322

FIGURE 391

CTGTGCAGCTCGAGGCTCCAGAGGCACACTCCAGAGAGAGCCAAGGTTCTGACGCGATGAGGA
AGCACCTGAGCTGGTGGTGGCTGGCCACTGTCTGCATGCTGCTCTTCAGCCACCTCTCTGCGG
TCCAGACGAGGGGCATCAAGCACAGAATCAAGTGGAACCGGAAGGCCCTGCCCAGCACTGCCC
AGATCACTGAGGCCCAGGTGGCTGAGAACCGCCCGGGAGCCTTCATCAAGCAAGGCCGCAAGC
TCGACATTGACTTCGGAGCCGAGGGCAACAGGTACTACGAGGCCAACTACTGGCAGTTCCCCG
ATGGCATCCACTACAACGGCTGCTCTGAGGCTAATGTGACCAAGGAGGCATTTGTCACCGGCT
GCATCAATGCCACCCAGGCGGCGAACCAGGGGGAGTTCCAGAAGCCAGACAACAAGCTCCACC
AGCAGGTGCTCTGGCGGCTGGTCCAGGAGCTCTGCTCCCTCAAGCATTGCGAGTTTTGGTTGG
AGAGGGGCGCAGGACTTCGGGTCACCATGCACCAGCCAGTGCTCCTCTGCCTTCTGGCTTTGA
TCTGGCTCATGGTGAAATAAGCTTGCCAGGAGGCTGGCAGTACAGAGCGCAGCAGCGAGCAAA
TCCTGGCAAGTGACCCAGCTCTTCTCCCCCAAACCCACGCGTGTTCTGAAGGTGCCCAGGAGC
GGCGATGCACTCGCACTGCAAATGCCGCTCCCACGTATGCGCCCTGGTATGTGCCTGCGTTCT
GATAGATGGGGGACTGTGGCTTCTCCGTCACTCCATTCTCAGCCCCTAGCAGAGCGTCTGGCA
CACTAGATTAGTAGTAAATGCTTGATGAGAAGAACACATCAGGCACTGCGCCACCTGCTTCAC
AGTACTTCCCAACAACTCTTAGAGGTAGGTGTATTCCCGTTTTACAGATAAGGAAACTGAGGC
CCAGAGAGCTGAAGTACTGCACCCAGCATCACCAGCTAGAAAGTGGCAGAGCCAGGATTCAAC
CCTGGCTTGTCTAACCCCAGGTTTTCTGCTCTGTCCAATTCCAGAGCTGTCTGGTGATCACTT
TATGTCTCACAGGGACCCACATCCAAACATGTATCTCTAATGAAATTGTGAAAGCTCCATGTT
TAGAAATAAATGAAAACACCTGA

FIGURE 392

MRKHLSWWWLATVCMLLFSHLSAVQTRGIKHRIKWNRKALPSTAQITEAQVAENRPGAFIKQG
RKLDIDFGAEGNRYYEANYWQFPDGIHYNGCSEANVTKEAFVTGCINATQAANQGEFQKPDNK
LHQQVLWRLVQELCSLKHCEFWLERGAGLRVTMHQPVLLCLLALIWLMVK

Important features of the protein:
Signal peptide:
amino acids 1-26

Transmembrane domain:
amino acids 157-171

N-glycosylation sites.
amino acids 98-102, 110-114

Tyrosine kinase phosphorylation site.
amino acids 76-83

N-myristoylation sites.
amino acids 71-77, 88-94, 93-99, 107-113, 154-160

Amidation site.
amino acids 62-66

FIGURE 393

TGAAATGACTTCCACGGCTGGGACGGGAACCTTCCACCCACAGCTATGCCTCTGATTGGTGAA
TGGTGAAGGTGCCTGTCTAACTTTTCTGTAAAAAGAACCAGCTGCCTCCAGGCAGCCAGCCCT
CAAGCATCACTTACAGGACCAGAGGGACAAGACATGACTGTGATGAGGAGCTGCTTTCGCCAA
TTTAACACCAAGAAGAATTGAGGCTGCTTGGGAGGAAGGCCAGGAGGAACACGAGACTGAGAG
ATGAATTTTCAACAGAGGCTGCAAAGCCTGTGGACTTTAGCCAGACCCTTCTGCCCTCCTTTG
CTGGCGACAGCCTCTCAAATGCAGATGGTTGTGCTCCCTTGCCTGGGTTTTACCCTGCTTCTC
TGGAGCCAGGTATCAGGGGCCCAGGGCCAAGAATTCCACTTTGGGCCCTGCCAAGTGAAGGGG
GTTGTTCCCCAGAAACTGTGGGAAGCCTTCTGGGCTGTGAAAGACACTATGCAAGCTCAGGAT
AACATCACGAGTGCCCGGCTGCTGCAGCAGGAGGTTCTGCAGAACGTCTCGGATGCTGAGAGC
TGTTACCTTGTCCACACCCTGCTGGAGTTCTACTTGAAAACTGTTTTCAAAAACCACCACAAT
AGAACAGTTGAAGTCAGGACTCTGAAGTCATTCTCTACTCTGGCCAACAACTTTGTTCTCATC
GTGTCACAACTGCAACCCAGTCAAGAAAATGAGATGTTTTCCATCAGAGACAGTGCACACAGG
CGGTTTCTGCTATTCCGGAGAGCATTCAAACAGTTGGACGTAGAAGCAGCTCTGACCAAAGCC
CTTGGGGAAGTGGACATTCTTCTGACCTGGATGCAGAAATTCTACAAGCTCTGAATGTCTAGA
CCAGGACCTCCCTCCCCCTGGCACTGGTTTGTTCCCTGTGTCATTTCAAACAGTCTCCCTTCC
TATGCTGTTCACTGGACACTTCACGCCCTTGGCCATGGGTCCCATTCTTGGCCCAGGATTATT
GTCAAAGAAGTCATTCTTTAAGCAGCGCCAGTGACAGTCAGGGAAGGTGCCTCTGGATGCTGT
GAAGAGTCTACAGAGAAGATTCTTGTATTTATTACAACTCTATTTAATTAATGTCAGTATTTC
AACTGAAGTTCTATTTATTTGTGAGACTGTAAGTTACATGAAGGCAGCAGAATATTGTGCCCC
ATGCTTCTTTACCCCTCACAATCCTTGCCACAGTGTGGGGCAGTGGATGGGTGCTTAGTAAGT
ACTTAATAAACTGTGGTGCTTTTTTTGGCCTGTCTTTGGATTGTTAAAAAACAGAGAGGGATG
CTTGGATGTAAAACTGAACTTCAGAGCATGAAAATCACACTGTCTTCTGATATCTGCAGGGAC
AGAGCATTGGGGTGGGGGTAAGGTGCATCTGTTTGAAAAGTAAACGATAAAATGTGGATTAAA
GTGCCCAGCACAAAGCAGATCCTCAATAAACATTTCATTTCCCACCCACACTCGCCAGCTCAC
CCCATCATCCCTTTCCCTTGGTGCCCTCCTTTTTTTTTATCCTAGTCATTCTTCCCTAATCT
TCCACTTGAGTGTCAAGCTGACCTTGCTGATGGTGACATTGCACCTGGATGTACTATCCAATC
TGTGATGACATTCCCTGCTAATAAAGACAACATAACTCCAAAAAAAAAAAAAAAAAAAAAAAA
AAAA

FIGURE 394

></usr/seqdb2/sst/DNA/Dnaseqs.full/ss.DNA88002
><subunit 1 of 1, 206 aa, 1 stop
><MW: 23799, pI: 9.12, NX(S/T): 3
MNFQQRLQSLWTLARPFCPPLLATASQMQMVVLPCLGFTLLLWSQVSGAQGQEFHFGPCQVKG
VVPQKLWEAFWAVKDTMQAQDNITSARLLQQEVLQNVSDAESCYLVHTLLEFYLKTVFKNHHN
RTVEVRTLKSFSTLANNFVLIVSQLQPSQENEMFSIRDSAHRRFLLFRRAFKQLDVEAALTKA
LGEVDILLTWMQKFYKL

Signal sequence:
amino acids 1-42

N-glycosylation sites.
amino acids 85-89, 99-103, 126-130

FIGURE 395

GCCTTGGCCTCCCAAAGGGCTGGGATTATAGGCGTGACCACCATGTCTGGTCCAGAGTCTCAT
TTCCTGATGATTTATAGACTCAAAGAAAACTCATGTTCAGAAGCTCTCTTCTCTTCTGGCCTC
CTCTCTGTCTTCTTTCCCTCTTTCTTCTTATTTTAATTAGTAGCATCTACTCAGAGTCATGCA
AGCTGGAAATCTTTCATTTTGCTTGTCAGTGGGGTAGGTCACTGAGTCTTAGTTTTTATTTTT
TGAAATTTCAACTTTCAGATTCAGGGGGTACATGTGAAGGTTTGTTTTATGAGTATATTGCAT
GATGCTGAGGTTTGGGGT

FIGURE 396

MFRSSLLFWPPLCLLSLFLLILISSIYSESCKLEIFHFACQWGRSLSLSFYFLKFQLSDSGGT
CEGLFYEYIA

Important features of the protein:
Signal peptide:
amino acids 1-25

N-myristoylation site.
amino acids 62-68

FIGURE 397

CATGCCGCTGCCGCCGCTGCTGCTGTTGCTCCTGGCGGCGCCTTGGGGACGGGCAGTTCCCTG
TGTCTCTGGTGGTTTGCCTAAACCTGCAAACATCACCTTCTTATCCATCAACATGAAGAATGT
CCTACAATGGACTCCACCAGAGGGTCTTCAAGGAGTTAAAGTTACTTACACTGTGCAGTATTT
CATATATGGGCAAAAGAAATGGCTGAATAAATCAGAATGCAGAAATATCAATAGAACCTACTG
TGATCTTTCTGCTGAAACTTCTGACTACGAACACCAGTATTATGCCAAAGTTAAGGCCATTTG
GGGAACAAAGTGTTCCAAATGGGCTGAAAGTGGACGGTTCTATCCTTTTTTAGAAACACAAAT
TGGCCCACCAGAGGTGGCACTGACTACAGATGAGAAGTCCATTTCTGTTGTCCTGACAGCTCC
AGAGAAGTGGAAGAGAAATCCAGAAGACCTTCCTGTTTCCATGCAACAAATATACTCCAATCT
GAAGTATAACGTGTCTGTGTTGAATACTAAATCAAACAGAACGTGGTCCCAGTGTGTGACCAA
CCACACGCTGGTGCTCACCTGGCTGGAGCCGAACACTCTTTACTGCGTACACGTGGAGTCCTT
CGTCCCAGGGCCCCCTCGCCGTGCTCAGCCTTCTGAGAAGCAGTGTGCCAGGACTTTGAAAGA
TCAATCATCAGAGTTCAAGGCTAAAATCATCTTCTGGTATGTTTTGCCCATATCTATTACCGT
GTTTCTTTTTTCTGTGATGGGCTATTCCATCTACCGATATATCCACGTTGGCAAAGAGAAACA
CCCAGCAAATTTGATTTTGATTTATGGAAATGAATTTGACAAAAGATTCTTTGTGCCTGCTGA
AAAAATCGTGATTAACTTTATCACCCTCAATATCTCGGATGATTCTAAAATTTCTCATCAGGA
TATGAGTTTACTGGGAAAAAGCAGTGATGTATCCAGCCTTAATGATCCTCAGCCCAGCGGGAA
CCTGAGGCCCCCTCAGGAGGAAGAGGAGGTGAAACATTTAGGGTATGCTTCGCATTTGATGGA
AATTTTTTGTGACTCTGAAGAAAACACGGAAGGTACTTCTCTCACCCAGCAAGAGTCCCTCAG
CAGAACAATACCCCCGGATAAAACAGTCATTGAATATGAATATGATGTCAGAACCACTGACAT
TTGTGCGGGGCCTGAAGAGCAGGAGCTCAGTTTGCAGGAGGAGGTGTCCACACAAGGAACATT
ATTGGAGTCGCAGGCAGCGTTGGCAGTCTTGGGCCCGCAAACGTTACAGTACTCATACACCCC
TCAGCTCCAAGACTTAGACCCCCTGGCGCAGGAGCACACAGACTCGGAGGAGGGGCCGGAGGA
AGAGCCATCGACGACCCTGGTCGACTGGGATCCCCAAACTGGCAGGCTGTGTATTCCTTCGCT
GTCCAGCTTCGACCAGGATTCAGAGGGCTGCGAGCCTTCTGAGGGGGATGGGCTCGGAGAGGA
GGGTCTTCTATCTAGACTCTATGAGGAGCCGGCTCCAGACAGGCCACCAGGAGAAAATGAAAC
CTATCTCATGCAATTCATGGAGGAATGGGGGTTATATGTGCAGATGGAAAACTGATGCCAACA
CTTCCTTTTGCCTTTTGTTTCCTGTGCAAACAAGTGAGTCACCCCTTTGATCCCAGCCATAAA
GTACCTGGGATGAAAGAAGTTTTTTCCAGTTTGTCAGTGTCTGTGAGAA

FIGURE 398

MPLPPLLLLLLAAPWGRAVPCVSGGLPKPANITFLSINMKNVLQWTPPEGLQGVKVTYTVQYF
IYGQKKWLNKSECRNINRTYCDLSAETSDYEHQYYAKVKAIWGTKCSKWAESGRFYPFLETQI
GPPEVALTTDEKSISVVLTAPEKWKRNPEDLPVSMQQIYSNLKYNVSVLNTKSNRTWSQCVTN
HTLVLTWLEPNTLYCVHVESFVPGPPRRAQPSEKQCARTLKDQSSEFKAKIIFWYVLPISITV
FLFSVMGYSIYRYIHVGKEKHPANLILIYGNEFDKRFFVPAEKIVINFITLNISDDSKISHQD
MSLLGKSSDVSSLNDPQPSGNLRPPQEEEEVKHLGYASHLMEIFCDSEENTEGTSLTQQESLS
RTIPPDKTVIEYEYDVRTTDICAGPEEQELSLQEEVSTQGTLLESQAALAVLGPQTLQYSYTP
QLQDLDPLAQEHTDSEEGPEEEPSTTLVDWDPQTGRLCIPSLSSFDQDSEGCEPSEGDGLGEE
GLLSRLYEEPAPDRPPGENETYLMQFMEEWGLYVQMEN

Signal sequence:
amino acids 1-18

Transmembrane domain:
amino acids 240-260

N-glycosylation sites.
amino acids 31-34, 72-75, 80-83, 171-174, 180-183, 189-192, 304-307, 523-526

Tyrosine kinase phosphorylation site.
amino acids 385-392, 518-526

N-myristoylation sites.
amino acids 53-58, 106-111, 368-373, 492-497

Tissue factor
amino acids 1-278

FIGURE 399

CCGGCGATGTCGCTCGTGCTGCTAAGCCTGGCCGCGCTGTGCAGGAGCGCCGTACCCCGAGAG
CCGACCGTTCAATGTGGCTCTGAAACTGGGCCATCTCCAGAGTGGATGCTACAACATGATCTA
ATCCCCGGAGACTTGAGGGACCTCCGAGTAGAACCTGTTACAACTAGTGTTGCAACAGGGGAC
TATTCAATTTTGATGAATGTAAGCTGGGTACTCCGGGCAGATGCCAGCATCCGCTTGTTGAAG
GCCACCAAGATTTGTGTGACGGGCAAAAGCAACTTCCAGTCCTACAGCTGTGTGAGGTGCAAT
TACACAGAGGCCTTCCAGACTCAGACCAGACCCTCTGGTGGTAAATGGACATTTTCCTACATC
GGCTTCCCTGTAGAGCTGAACACAGTCTATTTCATTGGGGCCCATAATATTCCTAATGCAAAT
ATGAATGAAGATGGCCCTTCCATGTCTGTGAATTTCACCTCACCAGGCTGCCTAGACCACATA
ATGAAATATAAAAAAAAGTGTGTCAAGGCCGGAAGCCTGTGGGATCCGAACATCACTGCTTGT
AAGAAGAATGAGGAGACAGTAGAAGTGAACTTCACAACCACTCCCCTGGGAAACAGATACATG
GCTCTTATCCAACACAGCACTATCATCGGGTTTTCTCAGGTGTTTGAGCCACACCAGAAGAAA
CAAACGCGAGCTTCAGTGGTGATTCCAGTGACTGGGGATAGTGAAGGTGCTACGGTGCAGCTG
ACTCCATATTTTCCTACTTGTGGCAGCGACTGCATCCGACATAAAGGAACAGTTGTGCTCTGC
CCACAAACAGGCGTCCCTTTCCCTCTGGATAACAACAAAAGCAAGCCGGGAGGCTGGCTGCCT
CTCCTCCTGCTGTCTCTGCTGGTGGCCACATGGGTGCTGGTGGCAGGGATCTATCTAATGTGG
AGGCACGAAAGGATCAAGAAGACTTCCTTTTCTACCACCACACTACTGCCCCCCATTAAGGTT
CTTGTGGTTTACCCATCTGAAATATGTTTCCATCACACAATTTGTTACTTCACTGAATTTCTT
CAAAACCATTGCAGAAGTGAGGTCATCCTTGAAAAGTGGCAGAAAAAGAAAATAGCAGAGATG
GGTCCAGTGCAGTGGCTTGCCACTCAAAAGAAGGCAGCAGACAAAGTCGTCTTCCTTCTTTCC
AATGACGTCAACAGTGTGTGCGATGGTACCTGTGGCAAGAGCGAGGGCAGTCCCAGTGAGAAC
TCTCAAGACCTCTTCCCCCTTGCCTTTAACCTTTTCTGCAGTGATCTAAGAAGCCAGATTCAT
CTGCACAAATACGTGGTGGTCTACTTTAGAGAGATTGATACAAAAGACGATTACAATGCTCTC
AGTGTCTGCCCCAAGTACCACCTCATGAAGGATGCCACTGCTTTCTGTGCAGAACTTCTCCAT
GTCAAGCAGCAGGTGTCAGCAGGAAAAAGATCACAAGCCTGCCACGATGGCTGCTGCTCCTTG
TAG

FIGURE 400

MSLVLLSLAALCRSAVPREPTVQCGSETGPSPEWMLQHDLIPGDLRDLRVEPVTTSVATGDYS
ILMNVSWVLRADASIRLLKATKICVTGKSNFQSYSCVRCNYTEAFQTQTRPSGGKWTFSYIGF
PVELNTVYFIGAHNIPNANMNEDGPSMSVNFTSPGCLDHIMKYKKKCVKAGSLWDPNITACKK
NEETVEVNFTTTPLGNRYMALIQHSTIIGFSQVFEPHQKKQTRASVVIPVTGDSEGATVQLTP
YFPTCGSDCIRHKGTVVLCPQTGVPFPLDNNKSKPGGWLPLLLLSLLVATWVLVAGIYLMWRH
ERIKKTSFSTTTLLPPIKVLVVYPSEICFHHTICYFTEFLQNHCRSEVILEKWQKKKIAEMGP
VQWLATQKKAADKVVFLLSNDVNSVCDGTCGKSEGSPSENSQDLFPLAFNLFCSDLRSQIHLH
KYVVVYFREIDTKDDYNALSVCPKYHLMKDATAFCAELLHVKQQVSAGKRSQACHDGCCSL

Important features of the protein:
Signal peptide:
amino acids 1-14

Transmembrane domain:
amino acids 290-309

N-glycosylation sites.
amino acids 67 - 71, 103 - 107, 156 - 160, 183 - 187, 197 - 201 and 283 - 287 cAMP- and cGMP-dependent protein kinase phosphorylation sites.
amino acids 228 - 232 and 319 - 323

Casein kinase II phosphorylation sites.
amino acids 178 - 182, 402 - 406, 414 - 418 and 453 - 457

N-myristoylation site.
amino acids 116-122

Amidation site.
amino acids 488-452

FIGURE 401

GGGAACAGGGAACTATCAGCCCGTCGGCCTCCGGGCCCTGCATTCTCTAGCCATGGACCG
GGACCTTTTGCGGCAGTCGCTAAATTGCCACGGGTCGTCTTTGCTCTCTCTACTTCGGAG
CGAACAGCAGGACAATCCACACTTCCGTAGCCTCCTGGGGTCGGCCGCCGAGCCAGCCCG
GGGCCCGCCGCCCCAGCACCCGTTGCAGGGCAGAAAAGAGAAGAGAGTTGACAACATCGA
GATACAGAAATTCATCTCCAAAAAAGCGGATCTGCTTTTTGCACTTTCCTGGAAATCAGA
TGCACCTGCAACTTCTGAAATTAATGAAGACAGTGAAGATCATTATGCAATCATGCCACC
TTTAGAGCAATTCATGGAGATACCTAGTATGGATCGGAGAGAGCTGTTTTTCCGAGATAT
TGAGCGTGGTGATATAGTGATTGGAAGAATTAGTTCTATTCGGGAATTCGGTTTTTTCAT
GGTGTTGATCTGTTTAGGAAGTGGTATCATGAGAGATATAGCCCACTTAGAAATCACAGC
TCTTTGTCCCTTAAGAGATGTGCCTTCTCACAGTAACCATGGGGATCCTTTATCATATTA
CCAAACTGGTGACATCATTCGAGCTGGAATCAAGGATATTGACAGATACCATGAAAAGCT
AGCAGTATCTCTGTATAGCTCTTCTCTTCCACCACACCTATCTGGTATTAAATTAGGTGT
AATTAGCTCTGAAGAGCTTCCTTTATACTACAGGAGAAGTGTTGAGCTAAATAGCAATTC
TTTGGAGTCCTATGAAAATGTCATGCAGAGTTCCTTGGGATTTGTTAATCCAGGAGTAGT
TGAATTCCTTCTAGAAAAACTAGGAATAGATGAATCTAATCCACCATCTTTAATGAGAGG
CCTACAAAGCAAAAATTTCTCTGAAGATGATTTTGCTTCTGCATTGAGAAAAAAACAATC
CGCATCTTGGGCTTTAAAATGTGTGAAGATCGGAGTTGACTATTTTAAAGTTGGACGCCA
TGTGGATGCTATGAATGAATACAATAAAGCTTTGGAAATAGACAAACAAAACGTGGAAGC
TTTGGTAGCTCGTGGAGCATTATATGCGACAAAAGGAAGTTTGAACAAAGCAATAGAAGA
TTTTGAGCTTGCATTAGAAAACTGTCCAACTCACAGAAATGCAAGAAAATACCTCTGCCA
GACACTTGTAGAGAGAGGAGGACAGTTAGAAGAAGAAGAAAAGTTTTTAAATGCTGAAAG
TTACTATAAGAAAGCCTTGGCTTTGGATGAGACTTTTAAAGATGCAGAGGATGCTTTGCA
GAAACTTCATAAATATATGCAGAAATCTTTGGAATTAAGAGAAAAACAAGCTGAAAAGGA
AGAAAAGCAGAAAACAAAGAAAATAGAAACAAGTGCAGAAAAGTTGCGTAAGCTCTTAAA
AGAAGAGAAGAGGCTAAAGAAGAAAAGAAGAAAATCAACTTCTTCTTCAAGTGTTTCTTC
TGCTGATGAATCAGTGTCTTCATCATCATCCTCTTCCTCTTCTGGTCACAAAAGGCATAA
GAAACATAAGAGGAACCGTTCAGAGTCTTCTCGCAGTTCCAGAAGGCATTCATCTAGGGC
ATCCTCAAATCAGATAGATCAGAATAGGAAAGATGAGTGCTACCCAGTTCCAGCTAATAC
TTCAGCATCTTTTCTTAACCATAAACAAGAAGTGGAGAAACTACTGGGGAAGCAGGATAG
GTTACAGTATGAAAAGACACAGATAAAAGAGAAAGATAGATGCCCTCTCTCTTCATCTTC
ACTTGAAATACCGGATGATTTTGGAGTGTACTCCTATTTATTTAAAAAGTTAACTATAAA
ACAGCCTCAGGCAGGTCCTTCAGGAGATATTCCAGAAGAGGGCATTGTTATCATAGATGA
CAGCTCCATTCATGTTACTGACCCTGAAGACCTTCAAGTGGGACAAGATATGGAGGTGGA
AGACAGTGGTATTGATGATCCTGACCACGGGTAGGCTTAGGTTTATGTGTGTGTATGTGT
CTTAGTTTTTAACAAAAAAATTAAAAAGTAAAAAAACTAAAAATAGAAAAATGCTTAGAG
AATAAGGATATAAAGAATATTTTTGTGCAGTTGAACAATGAGTGCTTAAGCTAAATGTCA
TCACAAAAGAGTAAAAAAATTTTACAAAATTAAAAATGTTTAAAGTTAAAAAGCTCTAGG
AAGCTAAGGTCAATTTATTATTGGAGAAATAAAATTATTTTTATGAATTTACTGT

FIGURE 402

MDRDLLRQSLNCHGSSLLSLLRSEQQDNPHFRSLLGSAAEPARGPPPQHPLQGRKEKRVD
NIEIQKFISKKADLLFALSWKSDAPATSEINEDSEDHYAIMPPLEQFMEIPSMDRRELFF
RDIERGDIVIGRISSIREFGFFMVLICLGSGIMRDIAHLEITALCPLRDVPSHSNHGDPL
SYYQTGDIIRAGIKDIDRYHEKLAVSLYSSSLPPHLSGIKLGVISSEELPLYYRRSVELN
SNSLESYENVMQSSLGFVNPGVVEFLLEKLGIDESNPPSLMRGLQSKNFSEDDFASALRK
KQSASWALKCVKIGVDYFKVGRHVDAMNEYNKALEIDKQNVEALVARGALYATKGSLNKA
IEDFELALENCPTHRNARKYLCQTLVERGGQLEEEEKFLNAESYYKKALALDETFKDAED
ALQKLHKYMQKSLELREKQAEKEEKQKTKKIETSAEKLRKLLKEEKRLKKKRRKSTSSSS
VSSADESVSSSSSSSSSGHKRHKKHKRNRSESSRSSRRHSSRASSNQIDQNRKDECYPVP
ANTSASFLNHKQEVEKLLGKQDRLQYEKTQIKEKDRCPLSSSSLEIPDDFGVYSYLFKKL
TIKQPQAGPSGDIPEEGIVIIDDSSIHVTDPEDLQVGQDMEVEDSGIDDPDHG

Important features of the protein:
Signal peptide:
Amino acids 1-23

Transmembrane domain:
Amino acids 138-155

N-glycosylation sites:
Amino acids 288-292;508-512;542-546 cAMP- and cGMP-dependent protein kinase phosphorylation sites:
Amino acids 300-304;472-476;473-477;517-521;598-602

N-myristoylation sites:
Amino acids 218-224;222-228;271-277;348-354

Amidation site:
Amino acids 52-56

Cell attachment sequence:
Amino acids 125-128

FIGURE 403

CCGAGGCGGGAGGAGCCCGAGGGGGCGCGAGCCCCGCATGAATCATTGTAGTCAATCATTTTC
CAGTTCTCAGCCGCTCAGTTGTGATCAAGGGACACGTGGTTTCCGAACTGCCAGCTCAGAATA
GGAAAATAACTTGGGATTTTATATTGGAAGACATGGATCTTGCTGCCAACGAGATCAGCATTT
ATGACAAACTTTCAGAGACTGTTGATTTGGTGAGACAGACCGGCCATCAGTGTGGCATGTCAG
AGAAGGCAATTGAAAAATTTATCAGACAGCTGCTGGAAAAGAATGAACCTCAGAGACCCCCCC
CGCAGTATCCTCTCCTTATAGTTGTGTATAAGGTTCTCGCAACCTTGGGATTAATCTTGCTCA
CTGCCTACTTTGTGATTCAACCTTTCAGCCCATTAGCACCTGAGCCAGTGCTTTCTGGAGCTC
ACACCTGGCGCTCACTCATCCATCACATTAGGCTGATGTCCTTGCCCATTGCCAAGAAGTACA
TGTCAGAAAATAAGGGAGTTCCTCTGCATGGGGGTGATGAAGACAGACCCTTTCCAGACTTTG
ACCCCTGGTGGACAAACGACTGTGAGCAGAATGAGTCAGAGCCCATTCCTGCCAACTGCACTG
GCTGTGCCCAGAAACACCTGAAGGTGATGCTCCTGGAAGACGCCCCAAGGAAATTTGAGAGGC
TCCATCCACTGGTGATCAAGACGGGAAAGCCCCTGTTGGAGGAAGAGATTCAGCATTTTTGT
GCCAGTACCCTGAGGCGACAGAAGGCTTCTCTGAAGGGTTTTTCGCCAAGTGGTGGCGCTGCT
TTCCTGAGCGGTGGTTCCCATTTCCTTATCCATGGAGGAGACCTCTGAACAGATCACAAATGT
TACGTGAGCTTTTTCCTGTTTTCACTCACCTGCCATTTCCAAAAGATGCCTCTTTAAACAAGT
GCTCCTTTCTTCACCCAGAACCTGTTGTGGGGAGTAAGATGCATAAGATGCCTGACCTATTTA
TCATTGGCAGCGGTGAGGCCATGTTGCAGCTCATCCCTCCCTTCCAGTGCCGAAGACATTGTC
AGTCTGTGGCCATGCCAATAGAGCCAGGGGATATCGGCTATGTCGACACCACCCACTGGAAGG
TCTACGTTATAGCCAGAGGGGTCCAGCCTTTGGTCATCTGCGATGGAACCGCTTTCTCAGAAC
TGTAGGAAATAGAACTGTGCACAGGAACAGCTTCCAGAGCCGAAAACCAGGTTGAAAGGGGAA
AAATAAAAACAAAAACGATGAAACTGCAAAAA

FIGURE 404

MDLAANEISIYDKLSETVDLVRQTGHQCGMSEKAIEKFIRQLLEKNEPQRPPPQYPLLIVVYK
VLATLGLILLTAYFVIQPFSPLAPEPVLSGAHTWRSLIHHIRLMSLPIAKKYMSENKGVPLHG
GDEDRPFPDFDPWWTNDCEQNESEPIPANCTGCAQKHLKVMLLEDAPRKFERLHPLVIKTGKP
LLEEEIQHFLCQYPEATEGFSEGFFAKWWRCFPERWFPFPYPWRRPLNRSQMLRELFPVFTHL
PFPKDASLNKCSFLHPEPVVGSKMHKMPDLFIIGSGEAMLQLIPPFQCRRHCQSVAMPIEPGD
IGYVDTTHWKVYVIARGVQPLVICDGTAFSEL

FIGURE 405

TGCCGGGCTGCGGGGCGCCTTGACTCTCCCTCCACCCTGCCTCCTCGGGCTCCACTCGTCTGCCCCTGGACTCCC
GTCTCCTCCTGTCCTCCGGCTTCCCAGAGCTCCCTCCTTATGGCAGCAGCTTCCCGCGTCTCCGGCGCAGCTTCT
CAGCGGACGACCCTCTCGCTCCGGGGCTGAGCCCAGTCCCTGGATGTTGCTGAAACTCTCGAGATCATGCGCGGG
TTTGGCTGCTGCTTCCCCGCCGGGTGCCACTGCCACCGCCGCCGCCTCTGCTGCCGCCGTCCGCGGGATGCTCAG
TAGCCCGCTGCCCGGCCCCCGCGATCCTGTGTTCCTCGGAAGCCGTTTGCTGCTGCAGAGTTGCACGAACTAGTC
ATGGTGCTGTGGGAGTCCCCGCGGCAGTGCAGCAGCTGGACACTTTGCGAGGGCTTTTGCTGGCTGCTGCTGCTG
CCCGTCATGCTACTCATCGTAGCCCGCCCGGTGAAGCTCGCTGCTTTCCCTACCTCCTTAAGTGACTGCCAAACG
CCCACCGGCTGGAATTGCTCTGGTTATGATGACAGAGAAAATGATCTCTTCCTCTGTGACACCAACACCTGTAAA
TTTGATGGGGAATGTTTAAGAATTGGAGACACTGTGACTTGCGTCTGTCAGTTCAAGTGCAACAATGACTATGTG
CCTGTGTGTGGCTCCAATGGGGAGAGCTACCAGAATGAGTGTTACCTGCGACAGGCTGCATGCAAACAGCAGAGT
GAGATACTTGTGGTGTCAGAAGGATCATGTGCCACAGATGCAGGATCAGGATCTGGAGATGGAGTCCATGAAGGC
TCTGGAGAAACTAGTCAAAAGGAGACATCCACCTGTGATATTTGCCAGTTTGGTGCAGAATGTGACGAAGATGCC
GAGGATGTCTGGTGTGTGTGTAATATTGACTGTTCTCAAACCAACTTCAATCCCCTCTGCGCTTCTGATGGGAAA
TCTTATGATAATGCATGCCAAATCAAAGAAGCATCGTGTCAGAAACAGGAGAAAATTGAAGTCATGTCTTTGGGT
CGATGTCAAGATAACACAACTACAACTACTAAGTCTGAAGATGGGCATTATGCAAGAACAGATTATGCAGAGAAT
GCTAACAAATTAGAAGAAAGTGCCAGAGAACACCACATACCTTGTCCGGAACATTACAATGGCTTCTGCATGCAT
GGGAAGTGTGAGCATTCTATCAATATGCAGGAGCCATCTTGCAGGTGTGATGCTGGTTATACTGGACAACACTGT
GAAAAAAAGGACTACAGTGTTCTATACGTTGTTCCCGGTCCTGTACGATTTCAGTATGTCTTAATCGCAGCTGTG
ATTGGAACAATTCAGATTGCTGTCATCTGTGTGGTGGTCCTCTGCATCACAAGGAAATGCCCCAGAAGCAACAGA
ATTCACAGACAGAAGCAAAATACAGGGCACTACAGTTCAGACAATACAACAAGAGCGTCCACGAGGTTAATCTAA
AGGGAGCATGTTTCACAGTGGCTGGACTACCGAGAGCTTGGACTACACAATACAGTATTATAGACAAAAGAATAA
GACAAGAGATCTACACATGTTGCCTTGCATTTGTGGTAATCTACACCAATGAAAACATGTACTACAGCTATATTT
GATTATGTATGGATATATTTGAAATAGTATACATTGTCTTGATGTTTTTTCTGTAATGTAAATAAACTATTTATA
TCACACAATATAGTTTTTTCTTTCCCATGTATTTGTTATATATAATAAATACTCAGTGATGAG

FIGURE 406

MVLWESPRQCSSWTLCEGFCWLLLLPVMLLIVARPVKLAAFPTSLSDCQTPTGWNCSGY
DDRENDLFLCDTNTCKFDGECLRIGDTVTCVCQFKCNNDYVPVCGSNGESYQNECYLRQ
AACKQQSEILVVSEGSCATDAGSGSGDGVHEGSGETSQKETSTCDICQFGAECDEDAED
VWCVCNIDCSQTNFNPLCASDGKSYDNACQIKEASCQKQEKIEVMSLGRCQDNTTTTTK
SEDGHYARTDYAENANKLEESAREHHIPCPEHYNGFCMHGKCEHSINMQEPSCRCDAGY
TGQHCEKKDYSVLYVVPGPVRFQYVLIAAVIGTIQIAVICVVVLCITRKCPRSNRIHRQ
KQNTGHYSSDNTTRASTRLI

FIGURE 407

CTCGCAGCCGAGCGCGGCCGGGGAAGGGCTCTCCTTCCAGCGCCGAGCACTGGGCCCTGGCAG
ACGCCCCAAGATTGTTGTGAGGAGTCTAGCCAGTTGGTGAGCGCTGTAATCTGAACCAGCTGT
GTCCAGACTGAGGCCCCATTTGCATTGTTTAACATACTTAGAAAATGAAGTGTTCATTTTTAA
CATTCCTCCTCCAATTGGTTTAATGCTGAATTACTGAAGAGGGCTAAGCAAAACCAGGTGCTT
GCGCTGAGGGCTCTGCAGTGGCTGGGAGGACCCCGGCGCTCTCCCCGTGTCCTCTCCACGACT
CGCTCGGCCCCTCTGGAATAAAACACCCGCGAGCCCCGAGGGCCCAGAGGAGGCCGACGTGCC
CGAGCTCCTCCGGGGGTCCCGCCCGCGAGCTTTCTTCTCGCCTTCGCATCTCCTCCTCGCGCG
TCTTGGACATGCCAGGAATAAAAAGGATACTCACTGTTACCATTCTGGCTCTCTGTCTTCCAA
GCCCTGGGAATGCACAGGCACAGTGCACGAATGGCTTTGACCTGGATCGCCAGTCAGGACAGT
GTTTAGATATTGATGAATGCCGAACCATCCCCGAGGCCTGCCGAGGAGACATGATGTGTGTTA
ACCAAAATGGCGGGTATTTATGCATTCCCCGGACAAACCCTGTGTATCGAGGGCCCTACTCGA
ACCCCTACTCGACCCCCTACTCAGGTCCGTACCCAGCAGCTGCCCCACCACTCTCAGCTCCAA
ACTATCCCACGATCTCCAGGCCTCTTATATGCCGCTTTGGATACCAGATGGATGAAAGCAACC
AATGTGTGGATGTGGACGAGTGTGCAACAGATTCCCACCAGTGCAACCCCACCCAGATCTGCA
TCAATACTGAAGGCGGGTACACCTGCTCCTGCACCGACGGATATTGGCTTCTGGAAGGCCAGT
GCTTAGACATTGATGAATGTCGCTATGGTTACTGCCAGCAGCTCTGTGCGAATGTTCCTGGAT
CCTATTCTTGTACATGCAACCCTGGTTTTACCCTCAATGAGGATGGAAGGTCTTGCCAAGATG
TGAACGAGTGTGCCACCGAGAACCCCTGCGTGCAAACCTGCGTCAACACCTACGGCTCTCTCA
TCTGCCGCTGTGACCCAGGATATGAACTTGAGGAAGATGGCGTTCATTGCAGTGATATGGACG
AGTGCAGCTTCTCTGAGTTCCTCTGCCAACATGAGTGTGTGAACCAGCCCGGCACATACTTCT
GCTCCTGCCCTCCAGGCTACATCCTGCTGGATGACAACCGAAGCTGCCAAGACATCAACGAAT
GTGAGCACAGGAACCACACGTGCAACCTGCAGCAGACGTGCTACAATTTACAAGGGGGCTTCA
AATGCATCGACCCCATCCGCTGTGAGGAGCCTTATCTGAGGATCAGTGATAACCGCTGTATGT
GTCCTGCTGAGAACCCTGGCTGCAGAGACCAGCCCTTTACCATCTTGTACCGGGACATGGACG
TGGTGTCAGGACGCTCCGTTCCCGCTGACATCTTCCAAATGCAAGCCACGACCCGCTACCCTG
GGGCCTATTACATTTTCCAGATCAAATCTGGGAATGAGGGCAGAGAATTTTACATGCGGCAAA
CGGGCCCCATCAGTGCCACCCTGGTGATGACACGCCCCATCAAAGGGCCCCGGGAAATCCAGC
TGGACTTGGAAATGATCACTGTCAACACTGTCATCAACTTCAGAGGCAGCTCCGTGATCCGAC
TGCGGATATATGTGTCGCAGTACCCATTCTGAGCCTCGGGCTGGAGCCTCCGACGCTGCCTCT
CATTGGCACCAAGGGACAGGAGAAGAGAGGAAATAACAGAGAGAATGAGAGCGACACAGACGT
TAGGCATTTCCTGCTGAACGTTTCCCCGAAGAGTCAGCCCCGACTTCCTGACTCTCACCTGTA
CTATTGCAGACCTGTCACCCTGCAGGACTTGCCACCCCCAGTTCCTATGACACAGTTATCAAA
AAGTATTATCATTGCTCCCCTGATAGAAGATTGTTGGTGAATTTTCAAGGCCTTCAGTTTATT
TCCACTATTTTCAAAGAAAATAGATTAGGTTTGCGGGGGTCTGAGTCTATGTTCAAAGACTGT
GAACAGCTTGCTGTCACTTCTTCACCTCTTCCACTCCTTCTCTCACTGTGTTACTGCTTTGCA
AAGACCCGGGAGCTGGCGGGGAACCCTGGGAGTAGCTAGTTTGCTTTTTGCGTACACAGAGAA
GGCTATGTAAACAAACCACAGCAGGATCGAAGGGTTTTTAGAGAATGTGTTTCAAAACCATGC
CTGGTATTTTCAACCATAAAAGAAGTTTCAGTTGTCCTTAAATTTGTATAACGGTTTAATTCT
GTCTTGTTCATTTTGAGTATTTTTAAAAAATATGTCGTAGAATTCCTTCGAAAGGCCTTCAGA
CACATGCTATGTTCTGTCTTCCCAAACCCAGTCTCCTCTCCATTTTAGCCCAGTGTTTTCTTT
GAGGACCCCTTAATCTTGCTTTCTTTAGAATTTTTACCCAATTGGATTGGAATGCAGAGGTCT
CCAAACTGATTAAATATTTGAAGAGA

FIGURE 408

MPGIKRILTVTILALCLPSPGNAQAQCTNGFDLDRQSGQCLDIDECRTIPEACRGDMMCVNQN
GGYLCIPRTNPVYRGPYSNPYSTPYSGPYPAAAPPLSAPNYPTISRPLICRFGYQMDESNQCV
DVDECATDSHQCNPTQICINTEGGYTCSCTDGYWLLEGQCLDIDECRYGYCQQLCANVPGSYS
CTCNPGFTLNEDGRSCQDVNECATENPCVQTCVNTYGSLICRCDPGYELEEDGVHCSDMDECS
FSEFLCQHECVNQPGTYFCSCPPGYILLDDNRSCQDINECEHRNHTCNLQQTCYNLQGGFKCI
DPIRCEEPYLRISDNRCMCPAENPGCRDQPFTILYRDMDVVSGRSVPADIFQMQATTRYPGAY
YIFQIKSGNEGREFYMRQTGPISATLVMTRPIKGPREIQLDLEMITVNTVINFRGSSVIRLRI
YVSQYPF

Important features of the protein:
Signal peptide:
amino acids 1-25

N-glycosylation sites.
amino acids 283-287, 296-300

N-myristoylation sites.
amino acids 21-27, 64-70, 149-155, 186-192, 226-232, 242-248, 267-273, 310-316

Aspartic acid and asparagine hydroxylation sites.
amino acids 144-156, 181-193, 262-274

Cell attachment sequence.
amino acids 54-57

Calcium-binding EGF-like.
amino acids 131-166, 172-205, 211-245, 251-286

FIGURE 409

CCCACGCGTCCGCGGACGCGTGGGTCGACTAGTTCTAGATCGCGAGCGGCCGCCCGCGGCTCA
GGGAGGAGCACCGACTGCGCCGCACCCTGAGAGATGGTTGGTGCCATGTGGAAGGTGATTGTT
TCGCTGGTCCTGTTGATGCCTGGCCCCTGTGATGGGCTGTTTCGCTCCCTATACAGAAGTGTT
TCCATGCCACCTAAGGGAGACTCAGGACAGCCATTATTTCTCACCCCTTACATTGAAGCTGGG
AAGATCCAAAAAGGAAGAGAATTGAGTTTGGTCGGCCCTTTCCCAGGACTGAACATGAAGAGT
TATGCCGGCTTCCTCACCGTGAATAAGACTTACAACAGCAACCTCTTCTTCTGGTTCTTCCCA
GCTCAGATACAGCCAGAAGATGCCCCAGTAGTTCTCTGGCTACAGGGTGGGCCGGGAGGTTCA
TCCATGTTTGGACTCTTTGTGGAACATGGGCCTTATGTTGTCACAAGTAACATGACCTTGCGT
GACAGAGACTTCCCCTGGACCACAACGCTCTCCATGCTTTACATTGACAATCCAGTGGGCACA
GGCTTCAGTTTTACTGATGATACCCACGGATATGCAGTCAATGAGGACGATGTAGCACGGGAT
TTATACAGTGCACTAATTCAGTTTTTCCAGATATTTCCTGAATATAAAAATAATGACTTTTAT
GTCACTGGGGAGTCTTATGCAGGGAAATATGTGCCAGCCATTGCACACCTCATCCATTCCCTC
AACCCTGTGAGAGAGGTGAAGATCAACCTGAACGGAATTGCTATTGGAGATGGATATTCTGAT
CCCGAATCAATTATAGGGGGCTATGCAGAATTCCTGTACCAAATTGGCTTGTTGGATGAGAAG
CAAAAAAAGTACTTCCAGAAGCAGTGCCATGAATGCATAGAACACATCAGGAAGCAGAACTGG
TTTGAGGCCTTTGAAATACTGGATAAACTACTAGATGGCGACTTAACAAGTGATCCTTCTTAC
TTCCAGAATGTTACAGGATGTAGTAATTACTATAACTTTTTGCGGTGCACGGAACCTGAGGAT
CAGCTTTACTATGTGAAATTTTTGTCACTCCCAGAGGTGAGACAAGCCATCCACGTGGGGAAT
CAGACTTTTAATGATGGAACTATAGTTGAAAAGTACTTGCGAGAAGATACAGTACAGTCAGTT
AAGCCATGGTTAACTGAAATCATGAATAATTATAAGGTTCTGATCTACAATGGCCAACTGGAC
ATCATCGTGGCAGCTGCCCTGACAGAGCGCTCCTTGATGGGCATGGACTGGAAAGGATCCCAG
GAATACAAGAAGGCAGAAAAAAAAGTTTGGAAGATCTTTAAATCTGACAGTGAAGTGGCTGGT
TACATCCGGCAAGCGGGTGACTTCCATCAGGTAATTATTCGAGGTGGAGGACATATTTTACCC
TATGACCAGCCTCTGAGAGCTTTTGACATGATTAATCGATTCATTTATGGAAAAGGATGGGAT
CCTTATGTTGGATAAACTACCTTCCCAAAAGAGAACATCAGAGGTTTTCATTGCTGAAAAGAA
AATCGTAAAAACAGAAAATGTCATAGGAATAAAAAAATTATCTTTTCATATCTGCAAGATTTT
TTTCATCAATAAAAATTATCCTTGAAACAAGTGAGCTTTTGTTTTTGGGGGGAGATGTTTACT
ACAAAATTAACATGAGTACATGAGTAAGAATTACATTATTTAACTTAAAGGATGAAAGGTATG
GATGATGTGACACTGAGACAAGATGTATAAATGAAATTTTAGGGTCTTGAATAGGAAGTTTTA
ATTTCTTCTAAGAGTAAGTGAAAAGTGCAGTTGTAACAAACAAAGCTGTAACATCTTTTTCTG
CCAATAACAGAAGTTTGGCATGCCGTGAAGGTGTTTGGAAATATTATTGGATAAGAATAGCTC
AATTATCCCAAATAAATGGATGAAGCTATAATAGTTTTGGGGAAAAGATTCTCAAATGTATAA
AGTCTTAGAACAAAAGAATTCTTTGAAATAAAAATATTATATATAAAAGTAAAAAAAAAA

FIGURE 410

MVGAMWKVIVSLVLLMPGPCDGLFRSLYRSVSMPPKGDSGQPLFLTPYIEAGKIQKGRELSLV
GPFPGLNMKSYAGFLTVNKTYNSNLFFWFFPAQIQPEDAPVVLWLQGGPGGSSMFGLFVEHGP
YVVTSNMTLRDRDFPWTTTLSMLYIDNPVGTGFSFTDDTHGYAVNEDDVARDLYSALIQFFQI
FPEYKNNDFYVTGESYAGKYVPAIAHLIHSLNPVREVKINLNGIAIGDGYSDPESIIGGYAEF
LYQIGLLDEKQKKYFQKQCHECIEHIRKQNWFEAFEILDKLLDGDLTSDPSYFQNVTGCSNYY
NFLRCTEPEDQLYYVKFLSLPEVRQAIHVGNQTFNDGTIVEKYLREDTVQSVKPWLTEIMNNY
KVLIYNGQLDIIVAAALTERSLMGMDWKGSQEYKKAEKKVWKIFKSDSEVAGYIRQAGDFHQV
IIRGGGHILPYDQPLRAFDMINRFIYGKGWDPYVG

Signal sequence:
amino acids 1-22

N-glycosylation site.
amino acids 81-85, 132-136, 307-311, 346-350

Casein kinase II phosphorylation site.
amino acids 134-138, 160-164, 240-244, 321-325, 334-338, 348-352, 353-357, 424-428

Tyrosine kinase phosphorylation site.
amino acids 423-432

N-myristoylation site.
amino acids 22-28, 110-116, 156-162, 232-238

Serine carboxypeptidases, serine active site.
amino acids 200-208

Crystallins beta and gamma 'Greek key' motif signature.
amino acids 375-391

FIGURE 411

GCAAGCCAAGGCGCTGTTTGAGAAGGTGAAGAAGTTCCGGACCCATGTGGAGGAGGGGACATTGTGTACCGCCT
CTACATGCGGCAGACCATCATCAAGGTGATCAAGTTCATCCTCATCATCTGCTACACCGTCTACTACGTGCACAA
CATCAAGTTCGACGTGGACTGCACCGTGGACATTGAGAGCCTGACGGGCTACCGCACCTACCGCTGTGCCCACCC
CCTGGCCACACTCTTCAAGATCCTGGCGTCCTTCTACATCAGCCTAGTCATCTTCTACGGCCTCATCTGCATGTA
CACACTGTGGTGGATGCTACGGCGCTCCCTCAAGAAGTACTCGTTTGAGTCGATCCGTGAGGAGAGCAGCTACAG
CGACATCCCCGACGTCAAGAACGACTTCGCCTTCATGCTGCACCTCATTGACCAATACGACCCGCTCTACTCCAA
GCGCTTCGCCGTCTTCCTGTCGGAGGTGAGTGAGAACAAGCTGCGGCAGCTGAACCTCAACAACGAGTGGACGCT
GGACAAGCTCCGGCAGCGGCTCACCAAGAACGCGCAGGACAAGCTGGAGCTGCACCTGTTCATGCTCAGTGGCAT
CCCTGACACTGTGTTTGACCTGGTGGAGCTGGAGGTCCTCAAGCTGGAGCTGATCCCCGACGTGACCATCCCGCC
CAGCATTGCCCAGCTCACGGGCCTCAAGGAGCTGTGGCTCTACCACACAGCGGCCAAGATTGAAGCGCCTGCGCT
GGCCTTCCTGCGCGAGAACCTGCGGGCGCTGCACATCAAGTTCACCGACATCAAGGAGATCCCGCTGTGGATCTA
TAGCCTGAAGACACTGGAGGAGCTGCACCTGACGGGCAACCTGAGCGCGGAGAACAACCGCTACATCGTCATCGA
CGGGCTGCGGGAGCTCAAACGCCTCAAGGTGCTGCGGCTCAAGAGCAACCTAAGCAAGCTGCCACAGGTGGTCAC
AGATGTGGGCGTGCACCTGCAGAAGCTGTCCATCAACAATGAGGGCACCAAGCTCATCGTCCTCAACAGCCTCAA
GAAGATGGCGAACCTGACTGAGCTGGAGCTGATCCGCTGCGACCTGGAGCGCATCCCCCACTCCATCTTCAGCCT
CCACAACCTGCAGGAGATTGACCTCAAGGACAACAACCTCAAGACCATCGAGGAGATCATCAGCTTCCAGCACCT
GCACCGCCTCACCTGCCTTAAGCTGTGGTACAACCACATCGCCTACATCCCCATCCAGATCGGCAACCTCACCAA
CCTGGAGCGCCTCTACCTGAACCGCAACAAGATCGAGAAGATCCCCACCCAGCTCTTCTACTGCCGCAAGCTGCG
CTACCTGGACCTCAGCCACAACAACCTGACCTTCCTCCCTGCCGACATCGGCCTCCTGCAGAACCTCCAGAACCT
AGCCATCACGGCCAACCGGATCGAGACGCTCCCTCCGGAGCTCTTCCAGTGCCGGAAGCTGCGGGCCCTGCACCT
GGGCAACAACGTGCTGCAGTCACTGCCCTCCAGGGTGGGCGAGCTGACCAACCTGACGCAGATCGAGCTGCGGGG
CAACCGGCTGGAGTGCCTGCCTGTGGAGCTGGGCGAGTGCCCACTGCTCAAGCGCAGCGGCTTGGTGGTGGAGGA
GGACCTGTTCAACACACTGCCACCCGAGGTGAAGGAGCGGCTGTGGAGGGCTGACAAGGAGCAGGCCTGAGCGAG
GCCGGCCCAGCACAGCAAGCAGCAGGACCGCTGCCCAGTCCTCAGGCCCGGAGGGGCAGGCCTAGCTTCTCCCAG
AACTCCCGGACAGCCAGGACAGCCTCGCGGCTGGGCAGGAGCCTGGGGCCGCTTGTGAGTCAGGCCAGAGCGAGA
GGACAGTATCTGTGGGGCTGGCCCCTTTTCTCCCTCTGAGACTCACGTCCCCCAGGGCAAGTGCTTGTGGAGGAG
AGCAAGTCTCAAGAGCGCAGTATTTGGATAATCAGGGTCTCCTCCCTGGAGGCCAGCTCTGCCCCAGGGGCTGAG
CTGCCACCAGAGGTCCTGGGACCCTCACTTTAGTTCTTGGTATTTATTTTTCTCCATCTCCCACCTCCTTCATCC
AGATAACTTATACATTCCCAAGAAAGTTCAGCCCAGATGGAAGGTGTTCAGGGAAAGGTGGGCTGCCTTTTCCCC
TTGTCCTTATTTAGCGATGCCGCCGGGCATTTAACACCCACCTGGACTTCAGCAGAGTGGTCCGGGGCGAACCAC
CCATGGGACGGTCACCCAGCAGTGCCGGGCTGGGCTCTGCGGTGCGGTCCACGGGAGAGCAGGCCTCCAGCTGGA
AAGGCCAGGCCTGGAGCTTGCCTCTTCAGTTTTTGTGGCAGTTTTAGTTTTTTGTTTTTTTTTTTTTTAATCAAA
AAACAATTTTTTTAAAAAAAAGCTTTGAAAATGGATGGTTTGGGTATTAAAAAGAAAAAAAAAACTTAAAAAAA
AAAAGACACTAACGGCCAGTGAGTTGGAGTCTCAGGGCAGGGTGGCAGTTTCCCTTGAGCAAAGCAGCCAGACGT
TGAACTGTGTTTCCTTTCCCTGGGCGCAGGGTGCAGGGTGTCTTCCGGATCTGGTGTGACCTTGGTCCAGGAGTT
CTATTTGTTCCTGGGGAGGGAGGTTTTTTTGTTTGTTTTTTTGGGTTTTTTTTGGTGTCTTGTTTTCTTTCTCCTCC
ATGTGTCTTGGCAGGCACTCATTTCTGTGGCTGTCGGCCAGAGGGAATGTTCTGGAGCTGCCAAGGAGGGAGGAG
ACTCGGGTTGGCTAATCCCCGGATGAACGGTGCTCCATTCGCACCTCCCCTCCTCGTGCCTGCCCTGCCTCTCCA
CGCACAGTGTTAAGGAGCCAAGAGGAGCCACTTCGCCCAGACTTTGTTTCCCCACCTCCTGCGGCATGGGTGTGT
CCAGTGCCACCGCTGGCCTCCGCTGCTTCCATCAGCCCTGTCGCCACCTGGTCCTTCATGAAGAGCAGACACTTA
GAGGCTGGTCGGGAATGGGGAGGTCGCCCCTGGGAGGGCAGGCGTTGGTTCCAAGCCGGTTCCCGTCCCTGGCGC
CTGGAGTGCACACAGCCCAGTCGGCACCTGGTGGCTGGAAGCCAACCTGCTTTAGATCACTCGGGTCCCCACCTT
AGAAGGGTCCCCGCCTTAGATCAATCACGTGGACACTAAGGCACGTTTTAGAGTCTCTTGTCTTAATGATTATGT
CCATCCGTCTGTCCGTCCATTTGTGTTTTCTGCGTCGTGTCATTGGATATAATCCTCAGAAATAATGCACACTAG
CCTCTGACAACCATGAAGCAAAAATCCGTTACATGTGGGTCTGAACTTGTAGACTCGGTCACAGTATCAAATAAA
ATCTATAACAGAAAAAAAAAAAAAAAA

FIGURE 412

MRQTIIKVIKFILIICYTVYYVHNIKFDVDCTVDIESLTGYRTYRCAHPLATLFKILASFYIS
LVIFYGLICMYTLWWMLRRSLKKYSFESIREESSYSDIPDVKNDFAFMLHLIDQYDPLYSKRF
AVFLSEVSENKLRQLNLNNEWTLDKLRQRLTKNAQDKLELHLFMLSGIPDTVFDLVELEVLKL
ELIPDVTIPPSIAQLTGLKELWLYHTAAKIEAPALAFLRENLRALHIKFTDIKEIPLWIYSLK
TLEELHLTGNLSAENNRYIVIDGLRELKRLKVLRLKSNLSKLPQVVTDVGVHLQKLSINNEGT
KLIVLNSLKKMANLTELELIRCDLERIPHSIFSLHNLQEIDLKDNNLKTIEEIISFQHLHRLT
CLKLWYNHIAYIPIQIGNLTNLERLYLNRNKIEKIPTQLFYCRKLRYLDLSHNNLTFLPADIG
LLQNLQNLAITANRIETLPPELFQCRKLRALHLGNNVLQSLPSRVGELTNLTQIELRGNRLEC
LPVELGECPLLKRSGLVVEEDLFNTLPPEVKERLWRADKEQA

Transmembrane domain:
amino acids 51-75 (type II)

N-glycosylation site.
amino acids 262-266, 290-294, 328-332, 396-400, 432-436, 491-495 cAMP- and cGMP-dependent protein kinase phosphorylation site.
amino acids 85-89

Casein kinase II phosphorylation site.
amino acids 91-95, 97-101, 177-181, 253-257, 330-334, 364-368, 398-402, 493-497

N-myristoylation site.
amino acids 173-179, 261-267, 395-401, 441-447

FIGURE 413

GAATCATCCACGCACCTGCAGCTCTGCTGAGAGAGTGCAAGCCGTGGGGGTTTTGAGCTCATC
TTCATCATTCATATGAGGAAATAAGTGGTAAAATCCTTGGAAATACAATGAGACTCATCAGAA
ACATTTACATATTTTGTAGTATTGTTATGACAGCAGAGGGTGATGCTCCAGAGCTGCCAGAAG
AAAGGGAACTGATGACCAACTGCTCCAACATGTCTCTAAGAAAGGTTCCCGCAGACTTGACCC
CAGCCACAACGACACTGGATTTATCCTATAACCTCCTTTTTCAACTCCAGAGTTCAGATTTTC
ATTCTGTCTCCAAACTGAGAGTTTTGATTCTATGCCATAACAGAATTCAACAGCTGGATCTCA
AAACCTTTGAATTCAACAAGGAGTTAAGATATTTAGATTTGTCTAATAACAGACTGAAGAGTG
TAACTTGGTATTTACTGGCAGGTCTCAGGTATTTAGATCTTTCTTTTAATGACTTTGACACCA
TGCCTATCTGTGAGGAAGCTGGCAACATGTCACACCTGGAAATCCTAGGTTTGAGTGGGGCAA
AAATACAAAAATCAGATTTCCAGAAAATTGCTCATCTGCATCTAAATACTGTCTTCTTAGGAT
TCAGAACTCTTCCTCATTATGAAGAAGGTAGCCTGCCCATCTTAAACACAACAAAACTGCACA
TTGTTTTACCAATGGACACAAATTTCTGGGTTCTTTTGCGTGATGGAATCAAGACTTCAAAAA
TATTAGAAATGACAAATATAGATGGCAAAAGCCAATTTGTAAGTTATGAAATGCAACGAAATC
TTAGTTTAGAAAATGCTAAGACATCGGTTCTATTGCTTAATAAAGTTGATTTACTCTGGGACG
ACCTTTTCCTTATCTTACAATTTGTTTGGCATACATCAGTGGAACACTTTCAGATCCGAAATG
TGACTTTTGGTGGTAAGGCTTATCTTGACCACAATTCATTTGACTACTCAAATACTGTAATGA
GAACTATAAAATTGGAGCATGTACATTTCAGAGTGTTTTACATTCAACAGGATAAAATCTATT
TGCTTTTGACCAAAATGGACATAGAAAACCTGACAATATCAAATGCACAAATGCCACACATGC
TTTTCCCGAATTATCCTACGAAATTCCAATATTTAAATTTTGCCAATAATATCTTAACAGACG
AGTTGTTTAAAAGAACTATCCAACTGCCTCACTTGAAAACTCTCATTTTGAATGGCAATAAAC
TGGAGACACTTTCTTTAGTAAGTTGCTTTGCTAACAACACACCCTTGGAACACTTGGATCTGA
GTCAAAATCTATTACAACATAAAAATGATGAAAATTGCTCATGGCCAGAAACTGTGGTCAATA
TGAATCTGTCATACAATAAATTGTCTGATTCTGTCTTCAGGTGCTTGCCCAAAAGTATTCAAA
TACTTGACCTAAATAATAACCAAATCCAAACTGTACCTAAAGAGACTATTCATCTGATGGCCT
TACGAGAACTAAATATTGCATTTAATTTTCTAACTGATCTCCCTGGATGCAGTCATTTCAGTA
GACTTTCAGTTCTGAACATTGAAATGAACTTCATTCTCAGCCCATCTCTGGATTTTGTTCAGA
GCTGCCAGGAAGTTAAAACTCTAAATGCGGGAAGAAATCCATTCCGGTGTACCTGTGAATTAA
AAAATTTCATTCAGCTTGAAACATATTCAGAGGTCATGATGGTTGGATGGTCAGATTCATACA
CCTGTGAATACCCTTTAAACCTAAGGGGAACTAGGTTAAAAGACGTTCATCTCCACGAATTAT
CTTGCAACACAGCTCTGTTGATTGTCACCATTGTGGTTATTATGCTAGTTCTGGGGTTGGCTG
TGGCCTTCTGCTGTCTCCACTTTGATCTGCCCTGGTATCTCAGGATGCTAGGTCAATGCACAC
AAACATGGCACAGGGTTAGGAAAACAACCCAAGAACAACTCAAGAGAAATGTCCGATTCCACG
CATTTATTTCATACAGTGAACATGATTCTCTGTGGGTGAAGAATGAATTGATCCCCAATCTAG
AGAAGGAAGATGGTTCTATCTTGATTTGCCTTTATGAAAGCTACTTTGACCCTGGCAAAAGCA
TTAGTGAAAATATTGTAAGCTTCATTGAGAAAAGCTATAAGTCCATCTTTGTTTTGTCTCCCA
ACTTTGTCCAGAATGAGTGGTGCCATTATGAATTCTACTTTGCCCACCACAATCTCTTCCATG
AAAATTCTGATCATATAATTCTTATCTTACTGGAACCCATTCCATTCTATTGCATTCCCACCA
GGTATCATAAACTGAAAGCTCTCCTGGAAAAAAAAAGCATACTTGGAATGGCCCAAGGATAGGC
GTAAATGTGGGCTTTTCTGGGCAAACCTTCGAGCTGCTATTAATGTTAATGTATTAGCCACCA
GAGAAATGTATGAACTGCAGACATTCACAGAGTTAAATGAAGAGTCTCGAGGTTCTACAATCT
CTCTGATGAGAACAGATTGTCTATAAAATCCCACAGTCCTTGGGAAGTTGGGGACCACATACA
CTGTTGGGATGTACATTGATACAACCTTTATGATGGCAATTTGACAATATTTATTAAAATAAA
AAATGGTTATTCCCTTCATATCAGTTTCTAGAAGGATTTCTAAGAATGTATCCTATAGAAACA
CCTTCACAAGTTTATAAGGGCTTATGGAAAAAGGTGTTCATCCCAGGATTGTTTATAATCATG
AAAAATGTGGCCAGGTGCAGTGGCTCACTCTTGTAATCCCAGCACTATGGGAGGCCAAGGTGG
GTGACCCACGAGGTCAAGAGATGGAGACCATCCTGGCCAACATGGTGAAACCCTGTCTCTACT
AAAAATACAAAAATTAGCTGGGCGTGATGGTGCACGCCTGTAGTCCCAGCTACTTGGGAGGCT
GAGGCAGGAGAATCGCTTGAACCCGGGAGGTGGCAGTTGCAGTGAGCTGAGATCGAGCCACTG
CACTCCAGCCTGGTGACAGAGCGAGACTCCATCTCAAAAAAAAAGAAAAAAAAAAAAAGAAAAAA
ATGGAAAACATCCTCATGGCCACAAAATAAGGTCTAATTCAATAAATTATAGTACATTAATGT
AATATAATATTACATGCCACTAAAAAGAATAAGGTAGCTGTATATTTCCTGGTATGGAAAAAA
CATATTAATATGTTATAAACTATTAGGTTGGTGCAAAACTAATTGTGGTTTTTGCCATTGAAA
TGGCATTGAAATAAAAGTGTAAAGAAATCTATACCAGATGTAGTAACAGTGGTTTGGGTCTGG
GAGGTTGGATTACAGGGAGCATTTGATTTCTATGTTGTGTATTTCTATAATGTTTGAATTGTT
TAGAATGAATCTGTATTTCTTTTATAAGTAGAAAAAAAATAAAGATAGTTTTTACAGCCT

FIGURE 414

MRLIRNIYIFCSIVMTAEGDAPELPEERELMTNCSNMSLRKVPADLTPATTTLDLSYNLLFQL
QSSDFHSVSKLRVLILCHNRIQQLDLKTFEFNKELRYLDLSNNRLKSVTWYLLAGLRYLDLSF
NDFDTMPICEEAGNMSHLEILGLSGAKIQKSDFQKIAHLHLNTVFLGFRTLPHYEEGSLPILN
TTKLHIVLPMDTNFWVLLRDGIKTSKILEMTNIDGKSQFVSYEMQRNLSLENAKTSVLLLNKV
DLLWDDLFLILQFVWHTSVEHFQIRNVTFGGKAYLDHNSFDYSNTVMRTIKLEHVHFRVFYIQ
QDKIYLLLTKMDIENLTISNAQMPHMLFPNYPTKFQYLNFANNILTDELFKRTIQLPHLKTLI
LNGNKLETLSLVSCFANNTPLEHLDLSQNLLQHKNDENCSWPETVVNMNLSYNKLSDSVFRCL
PKSIQILDLNNNQIQTVPKETIHLMALRELNIAFNFLTDLPGCSHFSRLSVLNIEMNFILSPS
LDFVQSCQEVKTLNAGRNPFRCTCELKNFIQLETYSEVMMVGWSDSYTCEYPLNLRGTRLKDV
HLHELSCNTALLIVTIVVIMLVLGLAVAFCCLHFDLPWYLRMLGQCTQTWHRVRKTTQEQLKR
NVRFHAFISYSEHDSLWVKNELIPNLEKEDGSILICLYESYFDPGKSISENIVSFIEKSYKSI
FVLSPNFVQNEWCHYEFYFAHHNLFHENSDHIILILLEPIPFYCIPTRYHKLKALLEKKAYLE
WPKDRRKCGLFWANLRAAINVNVLATREMYELQTFTELNEESRGSTISLMRTDCL

FIGURE 415

CGGACGCGTGGGCGGACGCGTGGGCCTGGGCAAGGGCCGGGGCGCCGGGCCGAGCCACCTCTTCCCCTCCCCCGC
TTCCCTGTCGCGCTCCGCTGGCTGGACGCGCTGGAGGAGTGGAGCAGCACCCGGCCGGCCCTGGGGCTGACAGT
CGGCAAAGTTTGGCCCGAAGAGGAAGTGGTCTCAAACCCCGGCAGGTGGCGACCAGGCCAGACCAGGGGCGCTCG
CTGCCTGCGGGCGGGCTGTAGGCGAGGGCGCGCCCCAGTGCCGAGACCCGGGGCTTCAGGAGCCGGCCCCGGGAG
AGAAGAGTGCGGCGGCGGACGGAGAAAACAACTCCAAAGTTGGCGAAAGGCACCGCCCCTACTCCCGGGCTGCCG
CCGCCTCCCCGCCCCCAGCCCTGGCATCCAGAGTACGGGTCGAGCCCGGGCCATGGAGCCCCCCTGGGGAGGCGG
CACCAGGGAGCCTGGGCGCCCGGGGCTCCGCCGCGACCCCATCGGGTAGACCACAGAAGCTCCGGGACCCTTCCG
GCACCTCTGGACAGCCCAGGATGCTGTTGGCCACCCTCCTCCTCCTCCTCCTTGGAGGCGCTCTGGCCCATCCAG
ACCGGATTATTTTTCCAAATCATGCTTGTGAGGACCCCCCAGCAGTGCTCTTAGAAGTGCAGGGCACCTTACAGA
GGCCCCTGGTCCGGGACAGCCGCACCTCCCCTGCCAACTGCACCTGGCTCATCCTGGGCAGCAAGGAACAGACTG
TCACCATCAGGTTCCAGAAGCTACACCTGGCCTGTGGCTCAGAGCGCTTAACCCTACGCTCCCCTCTCCAGCCAC
TGATCTCCCTGTGTGAGGCACCTCCCAGCCCTCTGCAGCTGCCCGGGGGCAACGTCACCATCACTTACAGCTATG
CTGGGGCCAGAGCACCCATGGGCCAGGGCTTCCTGCTCTCCTACAGCCAAGATTGGCTGATGTGCCTGCAGGAAG
AGTTTCAGTGCCTGAACCACCGCTGTGTATCTGCTGTCCAGCGCTGTGATGGGGTTGATGCCTGTGGCGATGGCT
CTGATGAAGCAGGTTGCAGCTCAGACCCCTTCCCTGGCCTGACCCCAAGACCCGTCCCCTCCCTGCCTTGCAATG
TCACCTTGGAGGACTTCTATGGGGTCTTCTCCTCTCCTGGATATACACACCTAGCCTCAGTCTCCCACCCCCAGT
CCTGCCATTGGCTGCTGGACCCCCATGATGGCCGGCGGCTGGCCGTGCGCTTCACAGCCCTGGACTTGGGCTTTG
GAGATGCAGTGCATGTGTATGACGGCCCTGGGCCCCCTGAGAGCTCCCGACTACTGCGTAGTCTCACCCACTTCA
GCAATGGCAAGGCTGTCACTGTGGAGACACTGTCTGGCCAGGCTGTTGTGTCCTACCACACAGTTGCTTGGAGCA
ATGGTCGTGGCTTCAATGCCACCTACCATGTGCGGGGCTATTGCTTGCCTTGGGACAGACCCTGTGGCTTAGGCT
CTGGCCTGGGAGCTGGCGAAGGCCTAGGTGAGCGCTGCTACAGTGAGGCACAGCGCTGTGACGGCTCATGGGACT
GTGCTGACGGCACAGATGAGGAGGACTGCCCAGGCTGCCCACCTGGACACTTCCCCTGTGGGGCTGCTGGCACCT
CTGGTGCCACAGCCTGCTACCTGCCTGCTGACCGCTGCAACTACCAGACTTTCTGTGCTGATGGAGCAGATGAGA
GACGCTGTCGGCATTGCCAGCCTGGCAATTTCCGATGCCGGGACGAGAAGTGCGTGTATGAGACGTGGGTGTGCG
ATGGGCAGCCAGACTGTGCGGACGGCAGTGATGAGTGGGACTGCTCCTATGTTCTGCCCCGCAAGGTCATTACAG
CTGCAGTCATTGGCAGCCTAGTGTGCGGCCTGCTCCTGGTCATCGCCCTGGGCTGCACCTGCAAGCTCTATGCCA
TTCGCACCCAGGAGTACAGCATCTTTGCCCCCCTCTCCCGGATGGAGGCTGAGATTGTGCAGCAGCAGGCACCCC
CTTCCTACGGGCAGCTCATTGCCCAGGGTGCCATCCCACCTGTAGAAGACTTTCCTACAGAGAATCCTAATGATA
ACTCAGTGCTGGGCAACCTGCGTTCTCTGCTACAGATCTTACGCCAGGATATGACTCCAGGAGGTGGCCCAGGTG
CCCGCCGTCGTCAGCGGGGCCGCTTGATGCGACGCCTGGTACGCCGTCTCCGCCGCTGGGGCTTGCTCCCTCGAA
CCAACACCCCGGCTCGGGCCTCTGAGGCCAGATCCCAGGTCACACCTTCTGCTGCTCCCCTTGAGGCCCTAGATG
GTGGCACAGGTCCAGCCCGTGAGGGCGGGGCAGTGGGTGGGCAAGATGGGGAGCAGGCACCCCCACTGCCCATCA
AGGCTCCCCTCCCATCTGCTAGCACGTCTCCAGCCCCCACTACTGTCCCTGAAGCCCCAGGGCCACTGCCCTCAC
TGCCCCTAGAGCCATCACTATTGTCTGGAGTGGTGCAGGCCCTGCGAGGCCGCCTGTTGCCCAGCCTGGGGCCCC
CAGGACCAACCCGGAGCCCCCCTGGACCCCACACAGCAGTCCTGGCCCTGGAAGATGAGGACGATGTGCTACTGG
TGCCACTGGCTGAGCCGGGGGTGTGGGTAGCTGAGGCAGAGGATGAGCCACTGCTTACCTGAGGGGACCTGGGGG
CTCTACTGAGGCCTCTCCCCTGGGGGCTCTACTCATAGTGGCACAACCTTTTAGAGGTGGGTCAGCCTCCCCTCC
ACCACTTCCTTCCCTGTCCCTGGATTTCAGGGACTTGGTGGGCCTCCCGTTGACCCTATGTAGCTGCTATAAAGT
TAAGTGTCCCTCAGGCAGGGAGAGGGCTCACAGAGTCTCCTCTGTACGTGGCCATGGCCAGACACCCCAGTCCCT
TCACCACCACCTGCTCCCCACGCCACCACCATTTGGGTGGCTGTTTTTAAAAAGTAAAGTTCTTAGAGGATCATA
GGTCTGGACACTCCATCCTTGCCAAACCTCTACCCAAAAGTGGCCTTAAGCACCGGAATGCCAATTAACTAGAGA
CCCTCCAGCCCCCAAGGGGAGGATTTGGGCAGAACCTGAGGTTTTGCCATCCACAATCCCTCCTACAGGGCCTGG
CTCACAAAAAGAGTGCAACAAATGCTTCTATTCCATAGCTACGGCATTGCTCAGTAAGTTGAGGTCAAAAATAAA
GGAATCATACATCTC

FIGURE 416

</usr/seqdb2/sst/DNA/Dnaseqs.min/ss.DNA49631
<subunit 1 of 1, 713 aa, 1 stop
<MW: 76193, pI: 5.42, NX(S/T): 4
MLLATLLLLLLGGALAHPDRIIFPNHACEDPPAVLLEVQGTLQRPLVRDSRTSPANCTWLILG
SKEQTVTIRFQKLHLACGSERLTLRSPLQPLISLCEAPPSPLQLPGGNVTITYSYAGARAPMG
QGFLLSYSQDWLMCLQEEFQCLNHRCVSAVQRCDGVDACGDGSDEAGCSSDPFPGLTPRPVPS
LPCNVTLEDFYGVFSSPGYTHLASVSHPQSCHWLLDPHDGRRLAVRFTALDLGFGDAVHVYDG
PGPPESSRLLRSLTHFSNGKAVTVETLSGQAVVSYHTVAWSNGRGFNATYHVRGYCLPWDRPC
GLGSGLGAGEGLGERCYSEAQRCDGSWDCADGTDEEDCPGCPPGHFPCGAAGTSGATACYLPA
DRCNYQTFCADGADERRCRHCQPGNFRCRDEKCVYETWVCDGQPDCADGSDEWDCSYVLPRKV
ITAAVIGSLVCGLLLVIALGCTCKLYAIRTQEYSIFAPLSRMEAEIVQQQAPPSYGQLIAQGA
IPPVEDFPTENPNDNSVLGNLRSLLQILRQDMTPGGGPGARRRQRGRLMRRLVRRLRRWGLLP
RTNTPARASEARSQVTPSAAPLEALDGGTGPAREGGAVGGQDGEQAPPLPIKAPLPSASTSPA
PTTVPEAPGPLPSLPLEPSLLSGVVQALRGRLLPSLGPPGPTRSPPGPHTAVLALEDEDDVLL
VPLAEPGVWVAEAEDEPLLT

Important features:
Signal peptide:
amino acids 1-16

Transmembrane domain:
amino acids 442-462

LDL-receptor class A (LDLRA) domain proteins
amino acids 411-431, 152-171, 331-350 and 374-393

FIGURE 417

GTCGTTCCTTTGCTCTCTCGCGCCCAGTCCTCCTCCCTGGTTCTCCTCAGCCGCTGTCGGAGGAGAGCACCCGGA
GACGCGGGCTGCAGTCGCGGCGGCTTCTCCCCGCCTGGGCGGCCTCGCCGCTGGGCAGGTGCTGAGCGCCCCTAG
AGCCTCCCTTGCCGCCTCCCTCCTCTGCCCGGCCGCAGCAGTGCACATGGGGTGTTGGAGGTAGATGGGCTCCCG
GCCCGGGAGGCGGCGGTGGATGCGGCGCTGGGCAGAAGCAGCCGCCGATTCCAGCTGCCCCGCGCGCCCCGGGCG
CCCCTGCGAGTCCCCGGTTCAGCCATGGGGACCTCTCCGAGCAGCAGCACCGCCCTCGCCTCCTGCAGCCGCATC
GCCCGCCGAGCCACAGCCACGATGATCGCGGGCTCCCTTCTCCTGCTTGGATTCCTTAGCACCACCACAGCTCAG
CCAGAACAGAAGGCCTCGAATCTCATTGGCACATACCGCCATGTTGACCGTGCCACCGGCCAGGTGCTAACCTGT
GACAAGTGTCCAGCAGGAACCTATGTCTCTGAGCATTGTACCAACACAAGCCTGCGCGTCTGCAGCAGTTGCCCT
GTGGGGACCTTTACCAGGCATGAGAATGGCATAGAGAAATGCCATGACTGTAGTCAGCCATGCCCATGGCCAATG
ATTGAGAAATTACCTTGTGCTGCCTTGACTGACCGAGAATGCACTTGCCCACCTGGCATGTTCCAGTCTAACGCT
ACCTGTGCCCCCCATACGGTGTGTCCTGTGGGTTGGGGTGTGCGGAAGAAAGGGACAGAGACTGAGGATGTGCGG
TGTAAGCAGTGTGCTCGGGGTACCTTCTCAGATGTGCCTTCTAGTGTGATGAAATGCAAAGCATACACAGACTGT
CTGAGTCAGAACCTGGTGGTGATCAAGCCGGGGACCAAGGAGACAGACAACGTCTGTGGCACACTCCCGTCCTTC
TCCAGCTCCACCTCACCTTCCCCTGGCACAGCCATCTTTCCACGCCCTGAGCACATGGAAACCCATGAAGTCCCT
TCCTCCACTTATGTTCCCAAAGGCATGAACTCAACAGAATCCAACTCTTCTGCCTCTGTTAGACCAAAGGTACTG
AGTAGCATCCAGGAAGGGACAGTCCCTGACAACACAAGCTCAGCAAGGGGGAAGGAAGACGTGAACAAGACCCTC
CCAAACCTTCAGGTAGTCAACCACCAGCAAGGCCCCCACCACAGACACATCCTGAAGCTGCTGCCGTCCATGGAG
GCCACTGGGGGCGAGAAGTCCAGCACGCCCATCAAGGGCCCCAAGAGGGGACATCCTAGACAGAACCTACACAAG
CATTTTGACATCAATGAGCATTTGCCCTGGATGATTGTGCTTTTCCTGCTGCTGGTGCTTGTGGTGATTGTGGTG
TGCAGTATCCGGAAAAGCTCGAGGACTCTGAAAAAGGGGCCCCGGCAGGATCCCAGTGCCATTGTGGAAAAGGCA
GGGCTGAAGAAATCCATGACTCCAACCCAGAACCGGGAGAAATGGATCTACTACTGCAATGGCCATGGTATCGAT
ATCCTGAAGCTTGTAGCAGCCCAAGTGGGAAGCCAGTGGAAAGATATCTATCAGTTTCTTTGCAATGCCAGTGAG
AGGGAGGTTGCTGCTTTCTCCAATGGGTACACAGCCGACCACGAGCGGGCCTACGCAGCTCTGCAGCACTGGACC
ATCCGGGGCCCCGAGGCCAGCCTCGCCCAGCTAATTAGCGCCCTGCGCCAGCACCGGAGAAACGATGTTGTGGAG
AAGATTCGTGGGCTGATGGAAGACACCACCCAGCTGGAAACTGACAAACTAGCTCTCCCGATGAGCCCCAGCCCG
CTTAGCCCGAGCCCCATCCCCAGCCCCAACGCGAAACTTGAGAATTCCGCTCTCCTGACGGTGGAGCCTTCCCCA
CAGGACAAGAACAAGGGCTTCTTCGTGGATGAGTCGGAGCCCCTTCTCCGCTGTGACTCTACATCCAGCGGCTCC
TCCGCGCTGAGCAGGAACGGTTCCTTTATTACCAAAGAAAAGAAGGACACAGTGTTGCGGCAGGTACGCCTGGAC
CCCTGTGACTTGCAGCCTATCTTTGATGACATGCTCCACTTTCTAAATCCTGAGGAGCTGCGGGTGATTGAAGAG
ATTCCCCAGGCTGAGGACAAACTAGACCGGCTATTCGAAATTATTGGAGTCAAGAGCCAGGAAGCCAGCCAGACC
CTCCTGGACTCTGTTTATAGCCATCTTCCTGACCTGCTGTAGAACATAGGGATACTGCATTCTGGAAATTACTCA
ATTTAGTGGCAGGGTGGTTTTTTAATTTTCTTCTGTTTCTGATTTTTGTTGTTTGGGGTGTGTGTGTGTGTTTGT
GTGTGTGTGTGTGTGTGTGTGTGTGTGTGTGTTTAACAGAGAATATGGCCAGTGCTTGAGTTCTTTCTCCTTCTC
TCTCTCTCTTTTTTTTTTAAATAACTCTTCTGGGAAGTTGGTTTATAAGCCTTTGCCAGGTGTAACTGTTGTGAA
ATACCCACCACTAAAGTTTTTTAAGTTCCATATTTTCTCCATTTTGCCTTCTTATGTATTTTCAAGATTATTCTG
TGCACTTTAAATTTACTTAACTTACCATAAATGCAGTGTGACTTTTCCCACACACTGGATTGTGAGGCTCTTAAC
TTCTTAAAAGTATAATGGCATCTTGTGAATCCTATAAGCAGTCTTTATGTCTCTTAACATTCACACCTACTTTTT
AAAAACAAATATTATTACTATTTTTATTATTGTTTGTCCTTTATAAATTTTCTTAAAGATTAAGAAAATTTAAGA
CCCCATTGAGTTACTGTAATGCAATTCAACTTTGAGTTATCTTTTAAATATGTCTTGTATAGTTCATATTCATGG
CTGAAACTTGACCACACTATTGCTGATTGTATGGTTTTCACCTGGACACCGTGTAGAATGCTTGATTACTTGTAC
TCTTCTTATGCTAATATGCTCTGGGCTGGAGAAATGAAATCCTCAAGCCATCAGGATTTGCTATTTAAGTGGCTT
GACAACTGGGCCACCAAAGAACTTGAACTTCACCTTTTAGGATTTGAGCTGTTCTGGAACACATTGCTGCACTTT
GGAAAGTCAAAATCAAGTGCCAGTGGCGCCCTTTCCATAGAGAATTTGCCCAGCTTTGCTTTAAAAGATGTCTTG
TTTTTTATATACACATAATCAATAGGTCCAATCTGCTCTCAAGGCCTTGGTCCTGGTGGGATTCCTTCACCAATT
ACTTTAATTAAAAATGGCTGCAACTGTAAGAACCCTTGTCTGATATATTTGCAACTATGCTCCCATTTACAAATG
TACCTTCTAATGCTCAGTTGCCAGGTTCCAATGCAAAGGTGGCGTGGACTCCCTTTGTGTGGGTGGGGTTTGTGG
GTAGTGGTGAAGGACCGATATCAGAAAAATGCCTTCAAGTGTACTAATTTATTAATAAACATTAGGTGTTTGTTA
AAAAAAAAA

FIGURE 418

></usr/seqdb2/sst/DNA/Dnaseqs.min/ss.DNA52594
><subunit 1 of 1, 655 aa, 1 stop
><MW: 71845, pI: 8.22, NX(S/T): 8
MGTSPSSSTALASCSRIARRATATMIAGSLLLLGFLSTTTAQPEQKASNLIGTYRHVDRATGQ
VLTCDKCPAGTYVSEHCTNTSLRVCSSCPVGTFTRHENGIEKCHDCSQPCPWPMIEKLPCAAL
TDRECTCPPGMFQSNATCAPHTVCPVGWGVRKKGTETEDVRCKQCARGTFSDVPSSVMKCKAY
TDCLSQNLVVIKPGTKETDNVCGTLPSFSSSTSPSPGTAIFPRPEHMETHEVPSSTYVPKGMN
STESNSSASVRPKVLSSIQEGTVPDNTSSARGKEDVNKTLPNLQVVNHQQGPHHRHILKLLPS
MEATGGEKSSTPIKGPKRGHPRQNLHKHFDINEHLPWMIVLFLLLVLVVIVVCSIRKSSRTLK
KGPRQDPSAIVEKAGLKKSMTPTQNREKWIYYCNGHGIDILKLVAAQVGSQWKDIYQFLCNAS
EREVAAFSNGYTADHERAYAALQHWTIRGPEASLAQLISALRQHRRNDVVEKIRGLMEDTTQL
ETDKLALPMSPSPLSPSPIPSPNAKLENSALLTVEPSPQDKNKGFFVDESEPLLRCDSTSSGS
SALSRNGSFITKEKKDTVLRQVRLDPCDLQPIFDDMLHFLNPEELRVIEEIPQAEDKLDRLFE
IIGVKSQEASQTLLDSVYSHLPDLL

Signal sequence:
amino acids 1-41

Transmembrane domain:
amino acids 350-370

FIGURE 419

ATGGCTGGTGACGGCGGGGCCGGGCAGGGGACCGGGGCCGCGGCCCGGGAGCGGGCCAGCTGCCGGGAGCCCTGA
ATCACCGCCTGGCCCGACTCCACCATGAACGTCGCGCTGCAGGAGCTGGGAGCTGGCAGCAACGTGGGATTCCAG
AAGGGGACAAGACAGCTGTTAGGCTCACGCACGCAGCTGGAGCTGGTCTTAGCAGGTGCCTCTCTACTGCTGGCT
GCACTGCTTCTGGGCTGCCTTGTGGCCCTAGGGGTCCAGTACCACAGAGACCCATCCCACAGCACCTGCCTTACA
GAGGCCTGCATTCGAGTGGCTGGAAAAATCCTGGAGTCCCTGGACCGAGGGGTGAGCCCCTGTGAGGACTTTTAC
CAGTTCTCCTGTGGGGGCTGGATTCGGAGGAACCCCCTGCCCGATGGGCGTTCTCGCTGGAACACCTTCAACAGC
CTCTGGGACCAAAACCAGGCCATACTGAAGCACCTGCTTGAAAACACCACCTTCAACTCCAGCAGTGAAGCTGAG
CAGAAGACACAGCGCTTCTACCTATCTTGCCTACAGGTGGAGCGCATTGAGGAGCTGGGAGCCCAGCCACTGAGA
GACCTCATTGAGAAGATTGGTGGTTGGAACATTACGGGGCCCTGGGACCAGGACAACTTTATGGAGGTGTTGAAG
GCAGTAGCAGGGACCTACAGGGCCACCCCATTCTTCACCGTCTACATCAGTGCCGACTCTAAGAGTTCCAACAGC
AATGTTATCCAGGTGGACCAGTCTGGGCTCTTTCTGCCCTCTCGGGATTACTACTTAAACAGAACTGCCAATGAG
AAAGTGCTCACTGCCTATCTGGATTACATGGAGGAACTGGGGATGCTGCTGGGTGGGCGGCCCACCTCCACGAGG
GAGCAGATGCAGCAGGTGCTGGAGTTGGAGATACAGCTGGCCAACATCACAGTGCCCCAGGACCAGCGGCGCGAC
GAGGAGAAGATCTACCACAAGATGAGCATTTCGGAGCTGCAGGCTCTGGCGCCCTCCATGGACTGGCTTGAGTTC
CTGTCTTTCTTGCTGTCACCATTGGAGTTGAGTGACTCTGAGCCTGTGGTGGTGTATGGGATGGATTATTTGCAG
CAGGTGTCAGAGCTCATCAACCGCACGGAACCAAGCATCCTGAACAATTACCTGATCTGGAACCTGGTGCAAAAG
ACAACCTCAAGCCTGGACCGACGCTTTGAGTCTGCACAAGAGAAGCTGCTGGAGACCCTCTATGGCACTAAGAAG
TCCTGTGTGCCGAGGTGGCAGACCTGCATCTCCAACACGGATGACGCCCTTGGCTTTGCTTTGGGGTCACTCTTC
GTGAAGGCCACGTTTGACCGGCAAAGCAAAGAAATTGCAGAGGGGATGATCAGCGAAATCCGGACCGCATTTGAG
GAGGCCCTGGGACAGCTGGTTTGGATGGATGAGAAGACCCGCCAGGCAGCCAAGGAGAAAGCAGATGCCATCTAT
GATATGATTGGTTTCCCAGACTTTATCCTGGAGCCCAAAGAGCTGGATGATGTTTATGACGGGTACGAAATTTCT
GAAGATTCTTTCTTCCAAAACATGTTGAATTTGTACAACTTCTCTGCCAAGGTTATGGCTGACCAGCTCCGCAAG
CCTCCCAGCCGAGACCAGTGGAGCATGACCCCCCAGACAGTGAATGCCTACTACCTTCCAACTAAGAATGAGATC
GTCTTCCCCGCTGGCATCCTGCAGGCCCCCTTCTATGCCCGCAACCACCCCAAGGCCCTGAACTTCGGTGGCATC
GGTGTGGTCATGGGCCATGAGTTGACGCATGCCTTTGATGACCAAGGGCGCGAGTATGACAAAGAAGGGAACCTG
CGGCCCTGGTGGCAGAATGAGTCCCTGGCAGCCTTCCGGAACCACACGGCCTGCATGGAGGAACAGTACAATCAA
TACCAGGTCAATGGGGAGAGGCTCAACGGCCGCCAGACGCTGGGGGAGAACATTACTGACAACGGGGGGCTGAAG
GCTGCCTACAATGCTTACAAAGCATGGCTGAGAAAGCATGGGGAGGAGCAGCAACTGCCAGCCGTGGGGCTCACC
AACCACCAGCTCTTCTTCGTGGGATTTGCCCAGGTGTGGTGCTCGGTCCGCACACCAGAGAGCTCTCACGAGGGG
CTGGTGACCGACCCCCACAGCCCTGCCCGCTTCCGCGTGCTGGGCACTCTCTCCAACTCCCGTGACTTCCTGCGG
CACTTCGGCTGCCCTGTCGGCTCCCCCATGAACCCAGGGCAGCTGTGTGAGGTGTGGTAGACCTGGATCAGGGGA
GAAATGGCCAGCTGTCACCAGACCTGGGGCAGCTCTCCTGACAAAGCTGTTTGCTCTTGGGTTGGGAGGAAGCAA
ATGCAAGCTGGGCTGGGTCTAGTCCCTCCCCCCCACAGGTGACATGAGTACAGACCCTCCTCAATCACCACATTG
TGCCTCTGCTTTGGGGGTGCCCCTGCCTCCAGCAGAGCCCCCACCATTCACTGTGACATCTTTCCGTGTCACCCT
GCCTGGAAGAGGTCTGGGTGGGGAGGCCAGTTCCCATAGGAAGGAGTCTGCC

FIGURE 420

MNVALQELGAGSNVGFQKGTRQLLGSRTQLELVLAGASLLLAALLLGCLVALGVQYHRDPSHS
TCLTEACIRVAGKILESLDRGVSPCEDFYQFSCGGWIRRNPLPDGRSRWNTFNSLWDQNQAIL
KHLLENTTFNSSSEAEQKTQRFYLSCLQVERIEELGAQPLRDLIEKIGGWNITGPWDQDNFME
VLKAVAGTYRATPFFTVYISADSKSSNSNVIQVDQSGLFLPSRDYYLNRTANEKVLTAYLDYM
EELGMLLGGRPTSTREQMQQVLELEIQLANITVPQDQRRDEEKIYHKMSISELQALAPSMDWL
EFLSFLLSPLELSDSEPVVVYGMDYLQQVSELINRTEPSILNNYLIWNLVQKTTSSLDRRFES
AQEKLLETLYGTKKSCVPRWQTCISNTDDALGFALGSLFVKATFDRQSKEIAEGMISEIRTAF
EEALGQLVWMDEKTRQAAKEKADAIYDMIGFPDFILEPKELDDVYDGYEISEDSFFQNMLNLY
NFSAKVMADQLRKPPSRDQWSMTPQTVNAYYLPTKNEIVFPAGILQAPFYARNHPKALNFGGI
GVVMGHELTHAFDDQGREYDKEGNLRPWWQNESLAAFRNHTACMEEQYNQYQVNGERLNGRQT
LGENITDNGGLKAAYNAYKAWLRKHGEEQQLPAVGLTNHQLFFVGFAQVWCSVRTPESSHEGL
VTDPHSPARFRVLGTLSNSRDFLRHFGCPVGSPMNPGQLCEVW

Type II Transmembrane domain:
amino acids 32-57

FIGURE 421

GGCGCCGCGTAGGCCCGGGAGGCCGGGCCGGCCGGGCTGCGAGCGCCTGCCCCATGCGCCGCC
GCCTCTCCGCACGATGTTCCCCTCGCGGAGGAAAGCGGCGCAGCTGCCCTGGGAGGACGGCAG
GTCCGGGTTGCTCTCCGGCGGCCTCCCTCGGAAGTGTTCCGTCTTCCACCTGTTCGTGGCCTG
CCTCTCGCTGGGCTTCTTCTCCCTACTCTGGCTGCAGCTCAGCTGCTCTGGGGACGTGGCCCG
GGCAGTCAGGGGACAAGGGCAGGAGACCTCGGGCCCTCCCCGTGCCTGCCCCCCAGAGCCGCC
CCCTGAGCACTGGGAAGAAGACGCATCCTGGGGCCCCCACCGCCTGGCAGTGCTGGTGCCCTT
CCGCGAACGCTTCGAGGAGCTCCTGGTCTTCGTGCCCCACATGCGCCGCTTCCTGAGCAGGAA
GAAGATCCGGCACCACATCTACGTGCTCAACCAGGTGGACCACTTCAGGTTCAACCGGGCAGC
GCTCATCAACGTGGGCTTCCTGGAGAGCAGCAACAGCACGGACTACATTGCCATGCACGACGT
TGACCTGCTCCCTCTCAACGAGGAGCTGGACTATGGCTTTCCTGAGGCTGGGCCCTTCCACGT
GGCCTCCCCGGAGCTCCACCCTCTCTACCACTACAAGACCTATGTCGGCGGCATCCTGCTGCT
CTCCAAGCAGCACTACCGGCTGTGCAATGGGATGTCCAACCGCTTCTGGGGCTGGGGCCGCGA
GGACGACGAGTTCTACCGGCGCATTAAGGGAGCTGGGCTCCAGCTTTTCCGCCCCTCGGGAAT
CACAACTGGGTACAAGACATTTCGCCACCTGCATGACCCAGCCTGGCGGAAGAGGGACCAGAA
GCGCATCGCAGCTCAAAAACAGGAGCAGTTCAAGGTGGACAGGGAGGGAGGCCTGAACACTGT
GAAGTACCATGTGGCTTCCCGCACTGCCCTGTCTGTGGGCGGGGCCCCCTGCACTGTCCTCAA
CATCATGTTGGACTGTGACAAGACCGCCACACCCTGGTGCACATTCAGCTGAGCTGGATGGAC
AGTGAGGAAGCCTGTACCTACAGGCCATATTGCTCAGGCTCAGGACAAGGCCTCAGGTCGTGG
GCCCAGCTCTGACAGGATGTGGAGTGGCCAGGACCAAGACAGCAAGCTACGCAATTGCAGCCA
CCCGGCCGCCAAGGCAGGCTTGGGCTGGGCCAGGACACGTGGGGTGCCTGGGACGCTGCTTGC
CATGCACAGTGATCAGAGAGAGGCTGGGGTGTGTCCTGTCCGGGACCCCCCCTGCCTTCCTGC
TCACCCTACTCTGACCTCCTTCACGTGCCCAGGCCTGTGGGTAGTGGGGAGGGCTGAACAGGA
CAACCTCTCATCACCCTACTCTGACCTCCTTCACGTGCCCAGGCCTGTGGGTAGTGGGGAGGG
CTGAACAGGACAACCTCTCATCACCCCCAAAAAAAAAAAAAAAAAAAAAAAAAAAAAAAAAAA
AAAAAAAAAAAA

FIGURE 422

></usr/seqdb2/sst/DNA/Dnaseqs.min/ss.DNA56531
><subunit 1 of 1, 327 aa, 1 stop
><MW: 37406, pI: 9.30, NX(S/T): 1
MFPSRRKAAQLPWEDGRSGLLSGGLPRKCSVFHLFVACLSLGFFSLLWLQLSCSGDVARAVRG
QGQETSGPPRACPPEPPPEHWEEDASWGPHRLAVLVPFRERFEELLVFVPHMRRFLSRKKIRH
HIYVLNQVDHFRFNRAALINVGFLESSNSTDYIAMHDVDLLPLNEELDYGFPEAGPFHVASPE
LHPLYHYKTYVGGILLLSKQHYRLCNGMSNRFWGWGREDDEFYRRIKGAGLQLFRPSGITTGY
KTFRHLHDPAWRKRDQKRIAAQKQEQFKVDREGGLNTVKYHVASRTALSVGGAPCTVLNIMLD
CDKTATPWCTFS

Signal peptide:
amino acids 1-42

Transmembrane domain:
amino acids 29-49 (type II)

N-glycosylation site.
amino acids 154-158 cAMP- and cGMP-dependent protein kinase phosphorylation site.
amino acids 27-31

Tyrosine kinase phosphorylation site.
amino acids 226-233

N-myristoylation site.
amino acids 19-25, 65-71, 247-253, 285-291, 303-309, 304-310

FIGURE 423

CCATCCCTGAGATCTTTTTATAAAAAACCCAGTCTTTGCTGACCAGACAAAGCATACCAGATC
TCACCAGAGAGTCGCAGACACTATGCTGCCTCCCATGGCCCTGCCCAGTGTGTCCTGGATGCT
GCTTTCCTGCCTCATTCTCCTGTGTCAGGTTCAAGGTGAAGAAACCCAGAAGGAACTGCCCTC
TCCACGGATCAGCTGTCCCAAAGGCTCCAAGGCCTATGGCTCCCCCTGCTATGCCTTGTTTTT
GTCACCAAAATCCTGGATGGATGCAGATCTGGCTTGCCAGAAGCGGCCCTCTGGAAAACTGGT
GTCTGTGCTCAGTGGGGCTGAGGGATCCTTCGTGTCCTCCCTGGTGAGGAGCATTAGTAACAG
CTACTCATACATCTGGATTGGGCTCCATGACCCCACACAGGGCTCTGAGCCTGATGGAGATGG
ATGGGAGTGGAGTAGCACTGATGTGATGAATTACTTTGCATGGGAGAAAAATCCCTCCACCAT
CTTAAACCCTGGCCACTGTGGGAGCCTGTCAAGAAGCACAGGATTTCTGAAGTGGAAAGATTA
TAACTGTGATGCAAAGTTACCCTATGTCTGCAAGTTCAAGGACTAGGGCAGGTGGGAAGTCAG
CAGCCTCAGCTTGGCGTGCAGCTCATCATGGACATGAGACCAGTGTGAAGACTCACCCTGGAA
GAGAATATTCTCCCCAAACTGCCCTACCTGACTACCTTGTCATGATCCTCCTTCTTTTTCCTT
TTTCTTCACCTTCATTTCAGGCTTTTCTCTGTCTTCCATGTCTTGAGATCTCAGAGAATAATA
ATAAAAATGTTACTTTATAAAAAAAAAAAAAAAAAAAAA

FIGURE 424

</usr/seqdb2/sst/DNA/Dnaseqs.min/ss.DNA56965
<subunit 1 of 1, 175 aa, 1 stop
<MW: 19330, pI: 7.25, NX(S/T): 1
MLPPMALPSVSWMLLSCLILLCQVQGEETQKELPSPRISCPKGSKAYGSPCYALFLSPKSWMD
ADLACQKRPSGKLVSVLSGAEGSFVSSLVRSISNSYSYIWIGLHDPTQGSEPDGDGWEWSSTD
VMNYFAWEKNPSTILNPGHCGSLSRSTGFLKWKDYNCDAKLPYVCKFKD

Important features:
Signal peptide:
amino acids 1-26

C-type lectin domain signature.
amino acids 146-171

FIGURE 425

CGGACGCGTGGGCCGCCACCTCCGGAACAAGCCATGGTGGCGGCGACGGTGGCAGCGGCGTGG
CTGCTCCTGTGGGCTGCGGCCTGCGCGCAGCAGGAGCAGGACTTCTACGACTTCAAGGCGGTC
AACATCCGGGGCAAACTGGTGTCGCTGGAGAAGTACCGCGGATCGGTGTCCCTGGTGGTGAAT
GTGGCCAGCGAGTGCGGCTTCACAGACCAGCACTACCGAGCCCTGCAGCAGCTGCAGCGAGAC
CTGGGCCCCCACCACTTTAACGTGCTCGCCTTCCCCTGCAACCAGTTTGGCCAACAGGAGCCT
GACAGCAACAAGGAGATTGAGAGCTTTGCCCGCCGCACCTACAGTGTCTCATTCCCCATGTTT
AGCAAGATTGCAGTCACCGGTACTGGTGCCCATCCTGCCTTCAAGTACCTGGCCCAGACTTCT
GGGAAGGAGCCCACCTGGAACTTCTGGAAGTACCTAGTAGCCCCAGATGGAAAGGTGGTAGGG
GCTTGGGACCCAACTGTGTCAGTGGAGGAGGTCAGACCCCAGATCACAGCGCTCGTGAGGAAG
CTCATCCTACTGAAGCGAGAAGACTTATAACCACCGCGTCTCCTCCTCCACCACCTCATCCCG
CCCACCTGTGTGGGGCTGACCAATGCAAACTCAAATGGTGCTTCAAAGGGAGAGACCCACTGA
CTCTCCTTCCTTTACTCTTATGCCATTGGTCCCATCATTCTTGTGGGGGAAAAATTCTAGTAT
TTTGATTATTTGAATCTTACAGCAACAAATAGGAACTCCTGGCCAATGAGAGCTCTTGACCAG
TGAATCACCAGCCGATACGAACGTCTTGCCAACAAAAATGTGTGGCAAATAGAAGTATATCAA
GCAATAATCTCCCACCCAAGGCTTCTGTAAACTGGGACCAATGATTACCTCATAGGGCTGTTG
TGAGGATTAGGATGAAATACCTGTGAAAGTGCCTAGGCAGTGCCAGCCAAATAGGAGGCATTC
AATGAACATTTTTTGCATATAAACCAAAAAATAACTTGTTATCAATAAAAACTTGCATCCAAC
ATGAATTTCCAGCCGATGATAATCCAGGCCAAAGGTTTAGTTGTTGTTATTTCCTCTGTATTA
TTTTCTTCATTACAAAAGAAATGCAAGTTCATTGTAACAATCCAAACAATACCTCACGATATA
AAATAAAAATGAAAGTATCCTCCTCAAAAA

FIGURE 426

MVAATVAAAWLLLWAAACAQQEQDFYDFKAVNIRGKLVSLEKYRGSVSLVVNVASECGFTDQH
YRALQQLQRDLGPHHFNVLAFPCNQFGQQEPDSNKEIESFARRTYSVSFPMFSKIAVTGTGAH
PAFKYLAQTSGKEPTWNFWKYLVAPDGKVVGAWDPTVSVEEVRPQITALVRKLILLKREDL

FIGURE 427

CAGTTCTGAAATCAATGGAGTTAATTTAGGGAATACAAACCAGCCATGGGGGTGGAGATTGCC
TTTGCCTCAGTGATTCTCACCTGCCTCTCCCTTCTGGCAGCAGGAGTCTCCCAGGTTGTTCTT
CTCCAGCCAGTTCCAACTCAGGAGACAGGTCCCAAGGCCATGGGAGATCTCTCCTGTGGCTTT
GCCGGCCACTCATGAGAGTGTTTTTGTGTAAAGTATTTTTTAGAATACTGTTGACTTCTTCAT
GATTTAATAACCATCCTTTGCGAAGTTTTATGAGGCTTTAGGGGAATGTCAACCCTCAAATTT
TTGTTATACTAGATGGCTTCCATTTACCCACCACTATTTTAAGGTCCCTTTATTTTTAGGTTC
AAGGTTCATTTGACTTGAGAAAGTGCCCTTCTGCAGCTTCATTGATTTTGTTTATCTTCACTA
TTAATTGTAACGATTAAAAAAGAATAAGAGCACGCAGACCTCTAGGAGAATATTTTATCCCTG
GGTGCCCCTGACACATTTATGTAGTGATCCCACAAATGTGATTGTTAATTTAAATGTTATTCT
AATATTAGTACATTCAGTTGTGATGTAATATGAATAACCAGAATCTATTTCTTAAAAGTTTTG
AGTATATTTTTCAACTAGATATTTGTATAGAAAGACTGAATAGTGATG

FIGURE 428

MGVEIAFASVILTCLSLLAAGVSQVVLLQPVPTQETGPKAMGDLSCGFAGHS

FIGURE 429

CCAAAGTGATCATTTGAAAAAGAGATATCCACATCTTCAAGCCCATATAAAGGATAGAAGCTG
CACAGGGCAGCTTTACTTACTCCAGCACCTTCCTCTCCCAGGCAAATGGTGCTGACCATCTTT
GGGATACAATCTCATGGATACGAGGTTTTTAACATCATCAGCCCAAGCAACAATGGTGGCAAT
GTTCAGGAGACAGTGACAATTGATAATGAAAAAAATACCGCCATCGTTAACATCCATGCAGGA
TCATGCTCTTCTACCACAATTTTTGACTATAAACATGGCTACATTGCATCCAGGGTGCTCTCC
CGAAGAGCCTGCTTTATCCTGAAGATGGACCATCAGAACATCCCTCCTCTGAACAATCTCCAA
TGGTACATCTATGAGAAACAGGCTCTGGACAACATGTTCTCCAACAAATACACCTGGGTCAAG
TACAACCCTCTGGAGTCTCTGATCAAAGACGTGGATTGGTTCCTGCTTGGGTCACCCATTGAG
AAACTCTGCAAACATATCCCTTTGTATAAGGGGGAAGTGGTTGAAAACACACATAATGTCGGT
GCTGGAGGCTGTGCAAAGGCTGGGCTCCTGGGCATCTTGGGAATTTCAATCTGTGCAGACATT
CATGTTTTAGGATGATTAGCCCTCTTGTTTTATCTTTTCAAAGAAATACATCCTTGGTTTACAC
TCAAAAGTCAAATTAAATTCTTTCCCAATGCCCCAACTAATTTTGAGATTCAGTCAGAAAATA
TAAATGCTGTATTTATA

FIGURE 430

><ss.DNA57834
><subunit 1 of 1, 176 aa, 1 stop
><MW: 19616, pI: 7.11, NX(S/T): 0
MVLTIFGIQSHGYEVFNIISPSNNGGNVQETVTIDNEKNTAIVNIHAGSCSSTTIFDYKH
GYIASRVLSRRACFILKMDHQNIPPLNNLQWYIYEKQALDNMFSNKYTWVKYNPLESLIK
DVDWFLLGSPIEKLCKHIPLYKGEVVENTHNVGAGGCAKAGLLGILGISICADIHV

Important features:
Signal peptide:
Amino acids 1-26

N-myristoylation sites:
Amino acids 48-54;153-159;156-162;167-173

FIGURE 431

GCGTGGGGATGTCTAGGAGCTCGAAGGTGGTGCTGGGCCTCTCGGTGCTGCTGACGGCGGCCA
CAGTGGCCGGCGTACATGTGAAGCAGCAGTGGGACCAGCAGAGGCTTCGTGACGGAGTTATCA
GAGACATTGAGAGGCAAATTCGGAAAAAAGAAAACATTCGTCTTTTGGGAGAACAGATTATTT
TGACTGAGCAACTTGAAGCAGAAAGAGAGAAGATGTTATTGGCAAAAGGATCTCAAAAATCAT
GACTTGAATGTGAAATATCTGTTGGACAGACAACACGAGTTTGTGTGTGTGTGTTGATGGAGA
GTAGCTTAGTAGTATCTTCATCTTTTTTTTTTGGTCACTGTCCTTTTAAACTTGATCAAATAAA
GGACAGTGGGTCATATAAGTTACTGCTTTCAGGGTCCCTTATATCTGAATAAAGGAGTGTGGG
CAGACACTTTTTGGAAGAGTCTGTCTGGGTGATCCTGGTAGAAGCCCCATTAGGGTCACTGTC
CAGTGCTTAGGGTTGTTACTGAGAAGCACTGCCGAGCTTGTGAGAAGGAAGGGATGGATAGTA
GCATCCACCTGAGTAGTCTGATCAGTCGGCATGATGACGAAGCCACGAGAACATCGACCTCAG
AAGGACTGGAGGAAGGTGAAGTGGAGGGAGAGACGCTCCTGATCGTCGAATCC

FIGURE 432

MSRSSKVVLGLSVLLTAATVAGVHVKQQWDQQRLRDGVIRDIERQIRKKENIRLLGEQIILTE
QLEAEREKMLLAKGSQKS

FIGURE 433

GAATTCGTGTCTCGGCACTCACTCCCGGCCGCCCGGACAGGGAGCTTTCGCTGGCGCGCTTGGCCGGCGACAGGA
CAGGTTCGGGACGTCCATCTGTCCATCCGTCCGGAGAGAAATTACAGATCCGCAGCCCCGGGATGGGGCCGGCCC
CGCTGCCGCTGCTGCTGGGCCTCTTCCTCCCCGCGCTCTGGCGTAGAGCTATCACTGAGGCAAGGGAAGAAGCCA
AGCCTTACCCGCTATTCCCGGGACCTTTTCCAGGGAGCCTGCAAACTGACCACACACCGCTGTTATCCCTTCCTC
ACGCCAGTGGGTACCAGCCTGCCTTGATGTTTTCACCAACCCAGCCTGGAAGACCACATACAGGAAACGTAGCCATT
CCCCAGGTGACCTCTGTCGAATCAAAGCCCCTACCGCCTCTTGCCTTCAAACACACAGTTGGACACATAATACTT
TCTGAACATAAAGGTGTCAAATTTAATTGCTCAATCAATGTACCTAATATATACCAGGACACCACAATTTCTTGG
TGGAAAGATGGGAAGGAATTGCTTGGGGGACATCATCGAATTACACAGTTTTATCCAGATGATGAAGTTACAGCA
ATAATCGCTTCCTTCAGCATAACCAGTGTGCAGCGTTCAGACAATGGGTCGTATATCTGTAAGATGAAAATAAAC
AATGAAGAGATCGTGTCTGATCCCATCTACATCGAAGTACAAGGACTTCCTCACTTTACTAAGCAGCCTGAGAGC
ATGAATGTCACCAGAAACACAGCCTTCAACCTCACCTGTCAGGCTGTGGGCCCGCCTGAGCCCGTCAACATTTTC
TGGGTTCAAAACAGTAGCCGTGTTAACGAACAGCCTGAAAAATCCCCCGGCGTGCTAACTGTTCCAGGCCTGACG
GAGATGGCGGTCTTCAGTTGTGAGGCCCACAATGACAAAGGGCTGACCGTGTCCCAGGGAGTGCAGATCAACATC
AAAGCAATTCCCTCCCCACCAACTGAAGTCAGCATCCGTAACAGCACTGCACACAGCATTCTGATCTCCTGGGTT
CCTGGTTTTGATGGATACTCCCCGTTCAGGAATTGCAGCATTCAGGTCAAGGAAGCTGATCCGCTGGGTAATGGC
TCAGTCATGATTTTTAACACCTCTGCCTTACCACATCTGTACCAAATCAAGCAGCTGCAAGCCCTGGCTAATTAC
AGCATTGGTGTTTCCTGCATGAATGAAATAGGCTGGTCTGCAGTGAGCCCTTGGATTCTAGCAAGCACGACTGAA
GGAGCCCCATCAGTAGCACCTTTAAATGTCACTGTGTTTCTGAATGAATCTAGTGATAATGTGGACATCAGATGG
ATGAAGCCTCCGACTAAGCAGCAGGATGGAGAACTGGTGGGCTACCGGATATCCCACGTGTGGCAGAGTGCAGGG
ATTTCCAAAGAGCTCTTGGAGGAAGTTGGCCAGAATGGCAGCCGAGCTCGGATCTCTGTTCAAGTCCACAATGCT
ACGTGCACAGTGAGGATTGCAGCCGTCACCAGAGGGGGAGTTGGGCCCTTCAGTGATCCAGTGAAAATATTTATC
CCTGCACACGGTTGGGTAGATTATGCCCCCTCTTCAACTCCGGCGCCTGGCAACGCAGATCCTGTGCTCATCATC
TTTGGCTGCTTTTGTGGATTTATTTTGATTGGGTTGATTTTATACATCTCCTTGGCCATCAGAAAAAGAGTCCAG
GAGACAAAGTTTGGGAATGCATTCACAGAGGAGGATTCTGAATTAGTGGTGAATTATATAGCAAAGAAATCCTTC
TGTCGGCGAGCCATTGAACTTACCTTACATAGCTTGGGAGTCAGTGAGGAACTACAAAATAAACTAGAAGATGTT
GTGATTGACAGGAATCTTCTAATTCTTGGAAAAATTCTGGGTGAAGGAGAGTTTGGGTCTGTAATGGAAGGAAAT
CTTAAGCAGGAAGATGGGACCTCTCTGAAAGTGGCAGTGAAGACCATGAAGTTGGACAACTCTTCACATCGGGAG
ATCGAGGAGTTTCTCAGTGAGGCAGCGTGCATGAAAGACTTCAGCCACCCAAATGTCATTCGACTTCTAGGTGTG
TGTATAGAAATGAGCTCTCAAGGCATCCCAAAGCCCATGGTAATTTTACCCTTCATGAAATACGGGGACCTGCAT
ACTTACTTACTTTATTCCCGATTGGAGACAGGACCAAAGCATATTCCTCTGCAGACACTATTGAAGTTCATGGTG
GATATTGCCCTGGGAATGGAGTATCTGAGCAACAGGAATTTTCTTCATCGAGATTTAGCTGCTCGAAACTGCATG
TTGCGAGATGACATGACTGTCTGTGTTGCGGACTTCGGCCTCTCTAAGAAGATTTACAGTGGCGATTATTACCGC
CAAGGCCGCATTGCTAAGATGCCTGTTAAATGGATCGCCATAGAAAGTCTTGCAGACCGAGTCTACACAAGTAAA
AGTGATGTGTGGGCATTTGGCGTGACCATGTGGGAAATACGTACGCGGGGAATGACTCCCTATCCTGGGGTCCAG
AACCATGAGATGTATGACTATCTTCTCCATGGCCACAGGTTGAAGCAGCCCGAAGACTGCCTGGATGAACTGTAT
GAAATAATGTACTCTTGCTGGAGAACCGATCCCTTAGACCGCCCCACCTTTTCAGTATTGAGGCTGCAGCTAGAA
AAACTCTTAGAAAGTTTGCCTGACGTTCGGAACCAAGCAGACGTTATTTACGTCAATACACAGTTGCTGGAGAGC
TCTGAGGGCCTGGCCCAGGGCCCCACCCTTGCTCCACTGGACTTGAACATCGACCCTGACTCTATAATTGCCTCC
TGCACTCCCCGCGCTGCCATCAGTGTGGTCACAGCAGAAGTTCATGACAGCAAACCTCATGAAGGACGGTACATC
CTGAATGGGGGCAGTGAGGAATGGGAAGATCTGACTTCTGCCCCCTCTGCTGCAGTCACAGCTGAAAAGAACAGT
GTTTTACCGGGGGAGAGACTTGTTAGGAATGGGGTCTCCTGGTCCCATTCGAGCATGCTGCCCCTTGGGAAGCTCA
TTGCCCGATGAACTTTTGTTTGCTGACGACTCCTCAGAAGGCTCAGAAGTCCTGATGTGAGGAGAGGTGCGGGGA
GACATTCCAAAAATCAAGCCAATTCTTCTGCTGTAGGAGAATCCAATTGTACCTGATGTTTTTGGTATTTGTCTT
CCTTACCAAGTGAACTCCATGGCCCCAAAGCACCAGATGAATGTTGTTAAGGAAGCTGTCATTAAAAATACATAA
TATATATTTATTTAAAGAGAAAAAATATGTGTATATCATGAAAAAGACAAGGATATTTTAATAAAACATTACTTA
TTTCATTTCACTTATCTTGCATATCTTAAAATTAAGCTTCAGCTGCTCCTTGATATTAACCTTTGTACAGAGTTG
AAGTTGTTTTTTCAACTTCTTTTCTTTTTCATTACTATTAAATGTAAAAATATTTGTAAAATGAAATGCCATATT
TGACTTGGCTTCTGGTCTTGATGTATTTGATAAGAATGATTAATTTTCTGATATGGCTTCCATAATAAAATTGAA
ATAGGA

FIGURE 434

MGPAPLPLLLGLFLPALWRRAITEAREEAKPYPLFPGPFPGSLQTDHTPLLSLPHASGYQPALMFSPTQPGRPHT
GNVAIPQVTSVESKPLPPLAFKHTVGHIILSEHKGVKFNCSINVPNIYQDTTISWWKDGKELLGGHHRITQFYPD
DEVTAIIASFSITSVQRSDNGSYICKMKINNEEIVSDPIYIEVQGLPHFTKQPESMNVTRNTAFNLTCQAVGPPE
PVNIFWVQNSSRVNEQPEKSPGVLTVPGLTEMAVFSCEAHNDKGLTVSQGVQINIKAIPSPPTEVSIRNSTAHSI
LISWVPGFDGYSPFRNCSIQVKEADPLGNGSVMIFNTSALPHLYQIKQLQALANYSIGVSCMNEIGWSAVSPWIL
ASTTEGAPSVAPLNVTVFLNESSDNVDIRWMKPPTKQQDGELVGYRISHVWQSAGISKELLEEVGQNGSRARISV
QVHNATCTVRIAAVTRGGVGPFSDPVKIFIPAHGWVDYAPSSTPAPGNADPVLIIFGCFCGFILIGLILYISLAI
RKRVQETKFGNAFTEEDSELVVNYIAKKSFCRRAIELTLHSLGVSEELQNKLEDVVIDRNLLILGKILGEGEFGS
VMEGNLKQEDGTSLKVAVKTMKLDNSSHREIEEFLSEAACMKDFSHPNVIRLLGVCIEMSSQGIPKPMVILPFMK
YGDLHTYLLYSRLETGPKHIPLQTLLKFMVDIALGMEYLSNRNFLHRDLAARNCMLRDDMTVCVADFGLSKKIYS
GDYYRQGRIAKMPVKWIAIESLADRVYTSKSDVWAFGVTMWEIRTRGMTPYPGVQNHEMYDYLLHGHRLKQPEDC
LDELYEIMYSCWRTDPLDRPTFSVLRLQLEKLLESLPDVRNQADVIYVNTQLLESSEGLAQGPTLAPLDLNIDPD
SIIASCTPRAAISVVTAEVHDSKPHEGRYILNGGSEEWEDLTSAPSAAVTAEKNSVLPGERLVRNGVSWSHSSML
PLGSSLPDELLFADDSSEGSEVLM

Signal sequence: Amino acids 1-18

Transmembrane domain: Amino acids 501-520

N-glycosylation sites: Amino acids 114-118;170-174;207-211;
215-219;234-238;294-298;316-320;329-333;
336-340;354-358;389-393;395-399;442-446;
454-458;625-629

Tyrosine kinase phosphorylation sites:
Amino acids 675-683;865-873;923-930

N-myristoylation sites: Amino acids 41-47;110-116;171-177;
269-275;275-281;440-446;507-513;535-541;
966-972

Prokaryotic membrane lipoprotein lipid attachment site:
Amino acids 351-362

Tyrosine protein kinases specific active-site signature:
Amino acids 719-732

FIGURE 435

AATGTGAGAGGGGCTGATGGAAGCTGATAGGCAGGACTGGAGTGTTAGCACCAGTACTGGATG
TGACAGCAGGCAGAGGAGCACTTAGCAGCTTATTCAGTGTCCGATTCTGATTCCGGCAAGGAT
CCAAGCATGGAATGCTGCCGTCGGGCAACTCCTGGCACACTGCTCCTCTTTCTGGCTTTCCTG
CTCCTGAGTTCCAGGACCGCACGCTCCGAGGAGGACCGGGACGGCCTATGGGATGCCTGGGGC
CCATGGAGTGAATGCTCACGCACCTGCGGGGGAGGGGCCTCCTACTCTCTGAGGCGCTGCCTG
AGCAGCAAGAGCTGTGAAGGAAGAAATATCCGATACAGAACATGCAGTAATGTGGACTGCCCA
CCAGAAGCAGGTGATTTCCGAGCTCAGCAATGCTCAGCTCATAATGATGTCAAGCACCATGGC
CAGTTTTATGAATGGCTTCCTGTGTCTAATGACCCTGACAACCCATGTTCACTCAAGTGCCAA
GCCAAAGGAACAACCCTGGTTGTTGAACTAGCACCTAAGGTCTTAGATGGTACGCGTTGCTAT
ACAGAATCTTTGGATATGTGCATCAGTGGTTTATGCCAAATTGTTGGCTGCGATCACCAGCTG
GGAAGCACCGTCAAGGAAGATAACTGTGGGTCTGCAACGGAGATGGGTCCACCTGCCGGCTG
GTCCGAGGGCAGTATAAATCCCAGCTCTCCGCAACCAAATCGGATGATACTGTGGTTGCACTT
CCCTATGGAAGTAGACATATTCGCCTTGTCTTAAAAGGTCCTGATCACTTATATCTGGAAACC
AAAACCCTCCAGGGGACTAAAGGTGAAAACAGTCTCAGCTCCACAGGAACTTTCCTTGTGGAC
AATTCTAGTGTGGACTTCCAGAAATTTCCAGACAAAGAGATACTGAGAATGGCTGGACCACTC
ACAGCAGATTTCATTGTCAAGATTCGTAACTCGGGCTCCGCTGACAGTACAGTCCAGTTCATC
TTCTATCAACCCATCATCCACCGATGGAGGGAGACGGATTTCTTTCCTTGCTCAGCAACCTGT
GGAGGAGGTTATCAGCTGACATCGGCTGAGTGCTACGATCTGAGGAGCAACCGTGTGGTTGCT
GACCAATACTGTCACTATTACCCAGAGAACATCAAACCCAAACCCAAGCTTCAGGAGTGCAAC
TTGGATCCTTGTCCAGCCAGTGACGGATACAAGCAGATCATGCCTTATGACCTCTACCATCCC
CTTCCTCGGTGGGAGGCCACCCCATGGACCGCGTGCTCCTCCTCGTGTGGGGGGGCATCCAG
AGCCGGGCAGTTTCCTGTGTGGAGGAGGACATCCAGGGGCATGTCACTTCAGTGGAAGAGTGG
AAATGCATGTACACCCCTAAGATGCCCATCGCGCAGCCCTGCAACATTTTTGACTGCCCTAAA
TGGCTGGCACAGGAGTGGTCTCCGTGCACAGTGACATGTGGCCAGGGCCTCAGATACCGTGTG
GTCCTCTGCATCGACCATCGAGGAATGCACACAGGAGGCTGTAGCCCAAAAACAAAGCCCCAC
ATAAAAGAGGAATGCATCGTACCCACTCCCTGCTATAAACCCAAAGAGAAACTTCCAGTCGAG
GCCAAGTTGCCATGGTTCAAACAAGCTCAAGAGCTAGAAGAAGGAGCTGCTGTGTCAGAGGAG
CCCTCGTAAGTTGTAAAAGCACAGACTGTTCTATATTTGAAACTGTTTTGTTTAAAGAAAGCA
GTGTCTCACTGGTTGTAGCTTTCATGGGTTCTGAACTAAGTGTAATCATCTCACCAAAGCTTT
TTGGCTCTCAAATTAAAGATTGATTAGTTTCAAAAAAAAAAA

FIGURE 436

</usr/seqdb2/sst/DNA/Dnaseqs.min/ss.DNA58847
<subunit 1 of 1, 525 aa, 1 stop
<MW: 58416, pI: 6.62, NX(S/T): 1
MECCRRATPGTLLLFLAFLLLSSRTARSEEDRDGLWDAWGPWSECSRTCGGGASYSLRRCLSS
KSCEGRNIRYRTCSNVDCPPEAGDFRAQQCSAHNDVKHHGQFYEWLPVSNDPDNPCSLKCQAK
GTTLVVELAPKVLDGTRCYTESLDMCISGLCQIVGCDHQLGSTVKEDNCGVCNGDGSTCRLVR
GQYKSQLSATKSDDTVVALPYGSRHIRLVLKGPDHLYLETKTLQGTKGENSLSSTGTFLVDNS
SVDFQKFPDKEILRMAGPLTADFIVKIRNSGSADSTVQFIFYQPIIHRWRETDFFPCSATCGG
GYQLTSAECYDLRSNRVVADQYCHYYPENIKPKPKLQECNLDPCPASDGYKQIMPYDLYHPLP
RWEATPWTACSSSCGGGIQSRAVSCVEEDIQGHVTSVEEWKCMYTPKMPIAQPCNIFDCPKWL
AQEWSPCTVTCGQGLRYRVVLCIDHRGMHTGGCSPKTKPHIKEECIVPTPCYKPKEKLPVEAK
LPWFKQAQELEEGAAVSEEPS

Important features:
Signal peptide:
amino acids 1-25

N-glycosylation site.
amino acids 251-254

Thrombospondin 1
amino acids 385-399 von Willebrand factor type C domain proteins
amino acids 385-399, 445-459 and 42-56

FIGURE 437

AACTGGAAGGAAAGAAAGAAAGGTCAGCTTTGGCCCAGATGTGGTTACCCCTTGGTCTCCTGT
CTTTATGTCTTTCTCCTCTTCCTATTCTGTCATCTCCCTCACTTAAGTCTCAGGCCTGTCAGC
AGCTCCTGTGGACATTGCCATCCCCTCTGGTAGCCTTCAGAGCAAACAGGACAACCTATGTTA
TGGATGTTTCCACCAACCAGGGTAGTGGCATGGAGCACCGTAACCATCTGTGCTTCTGTGATC
TCTATGACAGAGCCACTTCTCCACCTCTGAAATGTTCCCTGCTCTGAAATCTGGCATGAGATG
GCACAGGTGACCACGCAGAAGCCACCAGAATCTTGCCTGCCCTATTCCTCCTCCCAAGTCTGT
TCTCTTATTGTCAACCTCAGCACAACAGGCTGGCGCCAATGGCATTACAGAGAAAGCAATCTG
TGTGGCTAGTGGGCAGATTACCATGCAAGCCCCAGGAGAAATGGAGGAGCTTTGTAGCCACCT
CCCTGTCAGCCAGTATTAACATGTCCCCTTCCCCCTGCCCCGCCGTAGATTCAGGACATTCGC
CCCTGTGTGCCACCAAACCAGGACTTTCCCCTTGGCTTGGCATCCCTGGCTCTCTCCTGGTAC
CCAGCAAGACGTCTGTTCCAGGGCAGTGTAGCATCTTTCAAGCTCCGTTACTATGGCGATGGC
CATGATGTTACAATCCCACTTGCCTGAATAATCAAGTGGGAAGGGGAAGCAGAGGGAAATGGG
GCCATGTGAATGCAGCTGCTCTGTTCTCCCTACCCTGAGGAAAAACCAAAGGGAAGCAACAGG
AACTTCTGCAACTGGTTTTTATCGGAAAGATCATCCTGCCTGCAGATGCTGTTGAAGGGGCAC
AAGAAATGTAGCTGGAGAAGATTGATGAAAGTGCAGGTGTGTAAGGAAATAGAACAGTCTGCT
GGGAGTCAGACCTGGAATTCTGATTCCAAACTCTTTATTACTTTGGGAAGTCACTCAGCCTCC
CCGTAGCCATCTCCAGGGTGACGGAACCCAGTGTATTACCTGCTGGAACCAAGGAAACTAACA
ATGTAGGTTACTAGTGAATACCCCAATGGTTTCTCCAATTATGCCCATGCCACCAAAACAATA
AAACAAAATTCTCTAACACTGAAA

FIGURE 438

MWLPLGLLSLCLSPLPILSSPSLKSQACQQLLWTLPSPLVAFRANRTTYVMDVSTNQGSGMEH
RNHLCFCDLYDRATSPPLKCSLL

FIGURE 439

GTTTCTCATAGTTGGCGTCTTCTAAAGGAAAAACACTAAAATGAGGAACTCAGCGGACCGGGAGCGACGCAGCTT
GAGGGAAGCATCCCTAGCTGTTGGCGCAGAGGGGCGAGGCTGAAGCCGAGTGGCCCGAGGTGTCTGAGGGGCTGG
GGCAAAGGTGAAAGAGTTTCAGAACAAGCTTCCTGGAACCCATGACCCATGAAGTCTTGTCGACATTTATACCGT
CTGAGGGTAGCAGCTCGAAACTAGAAGAAGTGGAGTGTTGCCAGGGACGGCAGTATCTCTTTGTGTGACCCTGGC
GGCCTATGGGACGTTGGCTTCAGACCTTTGTGATACACCATGCTGCGTGGGACGATGACGGCGTGGAGAGGAATG
AGGCCTGAGGTCACACTGGCTTGCCTCCTCCTAGCCACAGCAGGCTGCTTTGCTGACTTGAACGAGGTCCCTCAG
GTCACCGTCCAGCCTGCGTCCACCGTCCAGAAGCCCGGAGGCACTGTGATCTTGGGCTGCGTGGTGGAACCTCCA
AGGATGAATGTAACCTGGCGCCTGAATGGAAAGGAGCTGAATGGCTCGGATGATGCTCTGGGTGTCCTCATCACC
CACGGGACCCTCGTCATCACTGCCCTTAACAACCACACTGTGGGACGGTACCAGTGTGTGGCCCGGATGCCTGCG
GGGGCTGTGGCCAGCGTGCCAGCCACTGTGACACTAGCCAATCTCCAGGACTTCAAGTTAGATGTGCAGCACGTG
ATTGAAGTGGATGAGGGAAACACAGCAGTCATTGCCTGCCACCTGCCTGAGAGCCACCCCAAAGCCCAGGTCCGG
TACAGCGTCAAACAAGAGTGGCTGGAGGCCTCCAGAGGTAACTACCTGATCATGCCCTCAGGGAACCTCCAGATT
GTGAATGCCAGCCAGGAGGACGAGGGCATGTACAAGTGTGCAGCCTACAACCCAGTGACCCAGGAAGTGAAAACC
TCCGGCTCCAGCGACAGGCTACGTGTGCGCCGCTCCACCGCTGAGGCTGCCCGCATCATCTACCCCCCAGAGGCC
CAAACCATCATCGTCACCAAAGGCCAGAGTCTCATTCTGGAGTGTGTGGCCAGTGGAATCCCACCCCCACGGGTC
ACCTGGGCCAAGGATGGGTCCAGTGTCACCGGCTACAACAAGACGCGCTTCCTGCTGAGCAACCTCCTCATCGAC
ACCACCAGCGAGGAGGACTCAGGCACCTACCGCTGCATGGCCGACAATGGGGTTGGGCAGCCCGGGGCAGCGGTC
ATCCTCTACAATGTCCAGGTGTTTGAACCCCCTGAGGTCACCATGGAGCTATCCCAGCTGGTCATCCCCTGGGGC
CAGAGTGCCAAGCTTACCTGTGAGGTGCGTGGGAACCCCCCGCCCTCCGTGCTGTGGCTGAGGAATGCTGTGCCC
CTCATCTCCAGCCAGCGCCTCCGGCTCTCCCGCAGGGCCCTGCGCGTGCTCAGCATGGGGCCTGAGGACGAAGGC
GTCTACCAGTGCATGGCCGAGAACGAGGTTGGGAGCGCCCATGCCGTAGTCCAGCTGCGGACCTCCAGGCCAAGC
ATAACCCCAAGGCTATGGCAGGATGCTGAGCTGGCTACTGGCACACCTCCTGTATCACCCTCCAAACTCGGCAAC
CCTGAGCAGATGCTGAGGGGGCAACCGGCGCTCCCCAGACCCCCAACGTCAGTGGGGCCTGCTTCCCCGAAGTGT
CCAGGAGAGAAGGGGCAGGGGGCTCCCGCCGAGGCTCCCATCATCCTCAGCTCGCCCCGCACCTCCAAGACAGAC
TCATATGAACTGGTGTGGCGGCCTCGGCATGAGGGCAGTGGCCGGGCGCCAATCCTCTACTATGTGGTGAAACAC
CGCAAGCAGGTCACAAATTCCTCTGACGATTGGACCATCTCTGGCATTCCAGCCAACCAGCACCGCCTGACCCTC
ACCAGACTTGACCCCGGGAGCTTGTATGAAGTGGAGATGGCAGCTTACAACTGTGCGGGAGAGGGCCAGACAGCC
ATGGTCACCTTCCGAACTGGACGGCGGCCCAAACCCGAGATCATGGCCAGCAAAGAGCAGCAGATCCAGAGAGAC
GACCCTGGAGCCAGTCCCCAGAGCAGCAGCCAGCCAGACCACGGCCGCCTCTCCCCCCCAGAAGCTCCCGACAGG
CCCACCATCTCCACGGCCTCCGAGACCTCAGTGTACGTGACCTGGATTCCCCGTGGGAATGGTGGGTTCCCAATC
CAGTCCTTCCGTGTGGAGTACAAGAAGCTAAAGAAAGTGGGAGACTGGATTCTGGCCACCAGCGCCATCCCCCCA
TCGCGGCTGTCCGTGGAGATCACGCCCCTAGAGAAAGGCACCTCCTACAAGTTTCGAGTCCGGGCTCTGAACATG
CTGGGGGAGAGCGAGCCCAGCGCCCCCTCTCGGCCCTACGTGGTGTCGGGCTACAGCGGTCGCGTGTACGAGAGG
CCCGTGGCAGGTCCTTATATCACCTTCACGGATGCGGTCAATGAGACCACCATCATGCTCAAGTGGATGTACATC
CCAGCAAGTAACAACAACACCCCAATCCATGGCTTTTATATCTATTATCGACCCACAGACAGTGACAATGATAGT
GACTACAAGAAGGATATGGTGGAAGGGGACAAGTACTGGCACTCCATCAGCCACCTGCAGCCAGAGACCTCCTAC
GACATTAAGATGCAGTGCTTCAATGAAGGAGGGGAGAGCGAGTTCAGCAACGTGATGATCTGTGAGACCAAAGCT
CGGAAGTCTTCTGGCCAGCCTGGTCGACTGCCACCCCCAACTCTGGCCCCACCACAGCCGCCCCTTCCTGAAACC
ATAGAGCGGCCGGTGGGCACTGGGGCCATGGTGGCTCGCTCCAGCGACCTGCCCTATCTGATTGTCGGGGTCGTC
CTGGGCTCCATCGTTCTCATCATCGTCACCTTCATCCCCTTCTGCTTGTGGAGGGCCTGGTCTAAGCAAAAACAT
ACAACAGACCTGGGTTTTCCTCGAAGTGCCCTTCCACCCTCCTGCCCGTATACTATGGTGCCATTGGGAGGACTC
CCAGGCCACCAGGCCAGTGGACAGCCCTACCTCAGTGGCATCAGTGGACGGGCCTGTGCTAATGGGATCCACATG
AATAGGGGCTGCCCCTCGGCTGCAGTGGGCTACCCGGGCATGAAGCCCCAGCAGCACTGCCCAGGCGAGCTTCAG
CAGCAGAGTGACACCAGCAGCCTGCTGAGGCAGACCCATCTTGGCAATGGATATGACCCCCAAAGTCACCAGATC
ACGAGGGGTCCCAAGTCTAGCCCGGACGAGGGCTCTTTCTTATACACACTGCCCGACGACTCCACTCACCAGCTG
CTGCAGCCCCATCACGACTGCTGCCAACGCCAGGAGCAGCCTGCTGCTGTGGGCCAGTCAGGGGTGAGGAGAGCC
CCCGACAGTCCTGTCCTGGAAGCAGTGTGGGACCCTCCATTTCACTCAGGGCCCCCATGCTGCTTGGGCCTTGTG
CCAGTTGAAGAGGTGGACAGTCCTGACTCCTGCCAAGTGAGTGGAGGAGACTGGTGTCCCCAGCACCCCGTAGGG
GCCTACGTAGGACAGGAACCTGGAATGCAGCTCTCCCCGGGGCCACTGGTGCGTGTGTCTTTTGAAACACCACCT
CTCACAATTTAGGCAGAAGCTGATATCCCAGAAAGACTATATATTGTTTTTTTTTTAAAAAAAAAAGAAGAAAAA
AGAGACAGAGAAAATTGGTATTTATTTTTCTATTATAGCCATATTTATATATTTATGCACTTGTAAATAAATGTA
TATGTTTTATAATTCTGGAGAGACATAAGGAGTCCTACCCGTTGAGGTTGGAGAGGGAAAATAAAGAAGCTGCCA
CCTAACAGGAGTCACCCAGGAAAGCACCGCACAGGCTGGCGCGGGACAGACTCCTAACCTGGGGCCTCTGCAGTG
GCAGGCGAGGCTGCAGGAGGCCCACAGATAAGCTGGCAAGAGGAAGGATCCCAGGCACATGGTTCATCACGAGCA
TGAGGGAACAGCAAGGGGCACGGTATCACAGCCTGGAGACACCCACACAGATGGCTGGATCCGGTGCTACGGGAA
ACATTTTCCTAAGATGCCCATGAGAACAGACCAAGATGTGTACAGCACTATGAGCATTAAAAAACCTTCCAGAAT
CAATAATCCGTGGCAACATATCTCTGTAAAAACAAACACTGTAACTTCTAAATAAATGTTTAGTCTTCCCTGTAAAA

FIGURE 440

MLRGTMTAWRGMRPEVTLACLLLATAGCFADLNEVPQVTVQPASTVQKPGGTVILGCVVEPPR
MNVTWRLNGKELNGSDDALGVLITHGTLVITALNNHTVGRYQCVARMPAGAVASVPATVTLAN
LQDFKLDVQHVIEVDEGNTAVIACHLPESHPKAQVRYSVKQEWLEASRGNYLIMPSGNLQIVN
ASQEDEGMYKCAAYNPVTQEVKTSGSSDRLRVRRSTAEAARIIYPPEAQTIIVTKGQSLILEC
VASGIPPPRVTWAKDGSSVTGYNKTRFLLSNLLIDTTSEEDSGTYRCMADNGVGQPGAAVILY
NVQVFEPPEVTMELSQLVIPWGQSAKLTCEVRGNPPPSVLWLRNAVPLISSQRLRLSRRALRV
LSMGPEDEGVYQCMAENEVGSAHAVVQLRTSRPSITPRLWQDAELATGTPPVSPSKLGNPEQM
LRGQPALPRPPTSVGPASPKCPGEKGQGAPAEAPIILSSPRTSKTDSYELVWRPRHEGSGRAP
ILYYVVKHRKQVTNSSDDWTISGIPANQHRLTLTRLDPGSLYEVEMAAYNCAGEGQTAMVTFR
TGRRPKPEIMASKEQQIQRDDPGASPQSSSQPDHGRLSPPEAPDRPTISTASETSVYVTWIPR
GNGGFPIQSFRVEYKKLKKVGDWILATSAIPPSRLSVEITGLEKGTSYKFRVRALNMLGESEP
SAPSRPYVVSGYSGRVYERPVAGPYITFTDAVNETTIMLKWMYIPASNNNTPIHGFYIYYRPT
DSDNDSDYKKDMVEGDKYWHSISHLQPETSYDIKMQCFNEGGESEFSNVMICETKARKSSGQP
GRLPPPTLAPPQPPLPETIERPVGTGAMVARSSDLPYLIVGVVLGSIVLIIVTFIPFCLWRAW
SKQKHTTDLGFPRSALPPSCPYTMVPLGGLPGHQASGQPYLSGISGRACANGIHMNRGCPSAA
VGYPGMKPQQHCPGELQQQSDTSSLLRQTHLGNGYDPQSHQITRGPKSSPDEGSFLYTLPDDS
THQLLQPHHDCCQRQEQPAAVGQSGVRRAPDSPVLEAVWDPPFHSGPPCCLGLVPVEEVDSPD
SCQVSGGDWCPQHPVGAYVGQEPGMQLSPGPLVRVSFETPPLTI

Signal peptide:
amino acids 1-30

Transmembrane domain:
amino acids 16-30 (type II), 854-879

FIGURE 441

GAGAGAATAGCTACAGATTCTCCATCCTCAGTCTTTGCAAGGCGACAGCTGTGCCAGCCGGGC
TCTGGCAGGCTCCTGGCAGCATGGCAGTGAAGCTTGGGACCCTCCTGCTGGCCCTTGCCCTGG
GCCTGGCCCAGCCAGCCTCTGCCCGCCGGAAGCTGCTGGTGTTTCTGCTGGATGGTTTTCGCT
CAGACTACATCAGTGATGAGGCGCTGGAGTCATTGCCTGGTTTCAAAGAGATTGTGAGCAGGG
GAGTAAAAGTGGATTACTTGACTCCAGACTTCCCTAGTCTCTCGTATCCCAATTATTATACCC
TAATGACTGGCCGCCATTGTGAAGTCCATCAGATGATCGGGAACTACATGTGGGACCCCACCA
CCAACAAGTCCTTTGACATTGGCGTCAACAAAGACAGCCTAATGCCTCTCTGGTGGAATGGAT
CAGAACCTCTGTGGGTCACTCTGACCAAGGCCAAAAGGAAGGTCTACATGTACTACTGGCCAG
GCTGTGAGGTTGAGATTCTGGGTGTCAGACCCACCTACTGCCTAGAATATAAAAATGTCCCAA
CGGATATCAATTTTGCCAATGCAGTCAGCGATGCTCTTGACTCCTTCAAGAGTGGCCGGGCCG
ACCTGGCAGCCATATACCATGAGCGCATTGACGTGGAAGGCCACCACTACGGGCCTGCATCTC
CGCAGAGGAAAGATGCCCTCAAGGCTGTAGACACTGTCCTGAAGTACATGACCAAGTGGATCC
AGGAGCGGGGCCTGCAGGACCGCCTGAACGTCATTATTTTCTCGGATCACGGAATGACCGACA
TTTTCTGGATGGACAAAGTGATTGAGCTGAATAAGTACATCAGCCTGAATGACCTGCAGCAAG
TGAAGGACCGCGGGCCTGTTGTGAGCCTTTGGCCGGCCCCTGGGAAACACTCTGAGATATATA
ACAAACTGAGCACAGTGGAACACATGACTGTCTACGAGAAAGAAGCCATCCCAAGCAGGTTCT
ATTACAAGAAAGGAAAGTTTGTCTCTCCTTTGACTTTAGTGGCTGATGAAGGCTGGTTCATAA
CTGAGAATCGAGAGATGCTTCCGTTTTGGATGAACAGCACCGGCAGGCGGGAAGGTTGGCAGC
GTGGATGGCACGGCTACGACAACGAGCTCATGGACATGCGGGGCATCTTCCTGGCCTTCGGAC
CTGATTTCAAATCCAACTTCAGAGCTGCTCCTATCAGGTCGGTGGACGTCTACAATGTCATGT
GCAATGTGGTGGGCATCACCCCGCTGCCCAACAACGGATCCTGGTCCAGGGTGATGTGCATGC
TGAAGGGCCGCGCCGGCACTGCCCCGCCTGTCTGGCCCAGCCACTGTGCCCTGGCACTGATTC
TTCTCTTCCTGCTTGCATAACTGATCATATTGCTTGTCTCAGAAAAAAACACCATCAGCAAAG
TGGGCCTCCAAAGCCAGATGATTTTCATTTTATGTGTGAATAATAGCTTCATTAACACAATCA
AGACCATGCACATTGTAAATACATTATTCTTGGATAATTCTATACATAAAAGTTCCTACTTGT
TAAA

FIGURE 442

MAVKLGTLLLALALGLAQPASARRKLLVFLLDGFRSDYISDEALESLPGFKEIVSRGVKVDYL
TPDFPSLSYPNYYTLMTGRHCEVHQMIGNYMWDPTTNKSFDIGVNKDSLMPLWWNGSEPLWVT
LTKAKRKVYMYYWPGCEVEILGVRPTYCLEYKNVPTDINFANAVSDALDSFKSGRADLAAIYH
ERIDVEGHHYGPASPQRKDALKAVDTVLKYMTKWIQERGLQDRLNVIIFSDHGMTDIFWMDKV
IELNKYISLNDLQQVKDRGPVVSLWPAPGKHSEIYNKLSTVEHMTVYEKEAIPSRFYYKKGKF
VSPLTLVADEGWFITENREMLPFWMNSTGRREGWQRGWHGYDNELMDMRGIFLAFGPDFKSNF
RAAPIRSVDVYNVMCNVVGITPLPNNGSWSRVMCMLKGRAGTAPPVWPSHCALALILLFLLA

Important features of the protein:
Signal peptide:
amino acids 1-22

N-glycosylation sites.
amino acids 100-104, 118-122, 341-345, 404-408

N-myristoylation sites.
amino acids 148-154, 365-371

Amidation site.
amino acids 343-347

FIGURE 443

```
AGTGACTGCAGCCTTCCTAGATCCCCTCCACTCGGTTTCTCTCTTTGCAGGAGCACCGGCAGC
ACCAGTGTGTGAGGGGAGCAGGCAGCGGTCCTAGCCAGTTCCTTGATCCTGCCAGACCACCCA
GCCCCCGGCACAGAGCTGCTCCACAGGCACC**ATG**AGGATCATGCTGCTATTCACAGCCATCCT
GGCCTTCAGCCTAGCTCAGAGCTTTGGGGCTGTCTGTAAGGAGCCACAGGAGGAGGTGGTTCC
TGGCGGGGCCGCAGCAAGAGGGATCCAGATCTCTACCAGCTGCTCCAGAGACTCTTCAAAAG
CCACTCATCTCTGGAGGGATTGCTCAAAGCCCTGAGCCAGGCTAGCACAGATCCTAAGGAATC
AACATCTCCCGAGAAACGTGACATGCATGACTTCTTTGTGGGACTTATGGGCAAGAGGAGCGT
CCAGCCAGAGGGAAAGACAGGACCTTTCTTACCTTCAGTGAGGGTTCCTCGGCCCCTTCATCC
CAATCAGCTTGGATCCACAGGAAAGTCTTCCCTGGGAACAGAGGAGCAGAGACCTTTA**TAA**GA
CTCTCCTACGGATGTGAATCAAGAGAACGTCCCCAGCTTTGGCATCCTCAAGTATCCCCCGAG
AGCAGAATAGGTACTCCACTTCCGGACTCCTGGACTGCATTAGGAAGACCTCTTTCCCTGTCC
CAATCCCCAGGTGCGCACGCTCCTGTTACCCTTTCTCTTCCCTGTTCTTGTAACATTCTTGTG
CTTTGACTCCTTCTCCATCTTTTCTACCTGACCCTGGTGTGGAAACTGCATAGTGAATATCCC
CAACCCCAATGGGCATTGACTGTAGAATACCCTAGAGTTCCTGTAGTGTCCTACATTAAAAAT
ATAATGTCTCTCTCTATTCCTCAACAATAAAGGATTTTTGCATATGAAAAAAAAAAAAAAAA
AAAAAAAAAAAAAAAAAAAAAAAAA
```

FIGURE 444

MRIMLLFTAILAFSLAQSFGAVCKEPQEEVVPGGGRSKRDPDLYQLLQRLFKSHSSLEGLLKA
LSQASTDPKESTSPEKRDMHDFFVGLMGKRSVQPEGKTGPFLPSVRVPRPLHPNQLGSTGKSS
LGTEEQRPL

Important features:
Signal peptide:
amino acids 1-18

Tyrosine kinase phosphorylation site.
amino acids 36-45

N-myristoylation site.
amino acids 33-39, 59-65

Amidation site.
amino acids 90-94

Leucine zipper pattern.
amino acids 43-65

Tachykinin family signature.
amino acids 86-92

FIGURE 445

TGGACTTCTCTGGACCACAGTCCTCTGCCAGACCCCTGCCAGACCCCAGTCCACCATGATCCATCTGGGTCACAT
CCTCTTCCTGCTTTTGCTCCCAGTGGCTGCAGCTCAGACGACTCCAGGAGAGAGATCATCACTCCCTGCCTTTTA
CCCTGGCACTTCAGGCTCTTGTTCCGGATGTGGGTCCCTCTCTCTGCCGCTCCTGGCAGGCCTCGTGGCTGCTGA
TGCGGTGGCATCGCTGCTCATCGTGGGGGCGGTGTTCCTGTGCGCACGCCCACGCCGCAGCCCCGCCCAAGATGG
CAAAGTCTACATCAACATGCCAGGCAGGGGCTGACCCTCCTGCAGCTTGGACCTTTGACTTCTGACCCTCTCATC
CTGGATGGTGTGTGGTGGCACAGGAACCCCCGCCCCAACTTTTGGATTGTAATAAAACAATTGAAACACCA

FIGURE 446

MIHLGHILFLLLLPVAAAQTTPGERSSLPAFYPGTSGSCSGCGSLSLPLLAGLVAADAVASLLIVGAVFLCARPR
RSPAQDGKVYINMPGRG

Signal peptide: Amino acids 1-18 transmembrane domain: Amino acids 51-70

Glycosaminoglycan attachment site: Amino acids 40-44

N-myristoylation sites: Amino acids 34-40;37-43;52-58

Prokaryotic membrane lipoprotein lipid attachment site:
Amino acids 29-40

FIGURE 447

GCCAGGTGTGCAGGCCGCTCCAAGCCCAGCCTGCCCCGCTGCCGCCACCATGACGCTCCTCCC
CGGCCTCCTGTTTCTGACCTGGCTGCACACATGCCTGGCCCACCATGACCCCTCCCTCAGGGG
GCACCCCCACAGTCACGGTACCCCACACTGCTACTCGGCTGAGGAACTGCCCCTCGGCCAGGC
CCCCCCACACCTGCTGGCTCGAGGTGCCAAGTGGGGGCAGGCTTTGCCTGTAGCCCTGGTGTC
CAGCCTGGAGGCAGCAAGCCACAGGGGGAGGCACGAGAGGCCCTCAGCTACGACCCAGTGCCC
GGTGCTGCGGCCGGAGGAGGTGTTGGAGGCAGACACCCACCAGCGCTCCATCTCACCCTGGAG
ATACCGTGTGGACACGGATGAGGACCGCTATCCACAGAAGCTGGCCTTCGCCGAGTGCCTGTG
CAGAGGCTGTATCGATGCACGGACGGGCCGCGAGACAGCTGCGCTCAACTCCGTGCGGCTGCT
CCAGAGCCTGCTGGTGCTGCGCCGCCGGCCCTGCTCCCGCGACGGCTCGGGGCTCCCCACACC
TGGGGCCTTTGCCTTCCACACCGAGTTCATCCACGTCCCCGTCGGCTGCACCTGCGTGCTGCC
CCGTTCAGTGTGACCGCCGAGGCCGTGGGGCCCCTAGACTGGACACGTGTGCTCCCCAGAGGG
CACCCCCTATTTATGTGTATTTATTGTTATTTATATGCCTCCCCCAACACTACCCTTGGGGTC
TGGGCATTCCCCGTGTCTGGAGGACAGCCCCCACTGTTCTCCTCATCTCCAGCCTCAGTAGT
TGGGGGTAGAAGGAGCTCAGCACCTCTTCCAGCCCTTAAAGCTGCAGAAAAGGTGTCACACGG
CTGCCTGTACCTTGGCTCCCTGTCCTGCTCCCGGCTTCCCTTACCCTATCACTGGCCTCAGGC
CCCGCAGGCTGCCTCTTCCCAACCTCCTTGGAAGTACCCCTGTTTCTTAAACAATTATTTAAG
TGTACGTGTATTATTAAACTGATGAACACATCCCCAAAA

FIGURE 448

MTLLPGLLFLTWLHTCLAHHDPSLRGHPHSHGTPHCYSAEELPLGQAPPHLLARGAKWGQALP
VALVSSLEAASHRGRHERPSATTQCPVLRPEEVLEADTHQRSISPWRYRVDTDEDRYPQKLAF
AECLCRGCIDARTGRETAALNSVRLLQSLLVLRRRPCSRDGSGLPTPGAFAFHTEFIHVPVGC
TCVLPRSV

Important features:
Signal peptide:
amino acids 1-18

Tyrosine kinase phosphorylation site.
amino acids 112-121

N-myristoylation sites.
amino acids 32-38, 55-61, 133-139

Leucine zipper pattern.
amino acids 3-25

Homologous region to IL-17.
amino acids 99-195

FIGURE 449

TGCAGAGCTTGTGGAGGCCATGGGGCGCGTCGTCGCGGAGCTCGTCTCCTCGCTGCTGGGGTT
GTGGCTGTTGCTGTGCAGCTGCGGATGCCCCGAGGGCGCCGAGCTGCGTGCTCCGCCAGATAA
AATCGCGATTATTGGAGCCGGAATTGGTGGCACTTCAGCAGCCTATTACCTGCGGCAGAAATT
TGGGAAAGATGTGAAGATAGACCTGTTTGAAAGAGAAGAGGTCGGGGGCCGCCTGGCTACCAT
GATGGTGCAGGGGCAAGAATACGAGGCAGGAGGTTCTGTCATCCATCCTTTAAATCTGCACAT
GAAACGTTTTGTCAAAGACCTGGGTCTCTCTGCTGTTCAGGCCTCTGGTGGCCTACTGGGGAT
ATATAATGGAGAGACTCTGGTATTTGAGGAGAGCAACTGGTTCATAATTAACGTGATTAAATT
AGTTTGGCGCTATGGATTTCAATCCCTCCGTATGCACATGTGGGTAGAGGACGTGTTAGACAA
GTTCATGAGGATCTACCGCTACCAGTCTCATGACTATGCCTTCAGTAGTGTCGAAAAATTACT
TCATGCTCTAGGAGGAGATGACTTCCTTGGAATGCTTAATCGAACACTTCTTGAAACCTTGCA
AAAGGCCGGCTTTTCTGAGAAGTTCCTCAATGAAATGATTGCTCCTGTTATGAGGGTCAATTA
TGGCCAAAGCACGGACATCAATGCCTTTGTGGGGGCGGTGTCACTGTCCTGTTCTGATTCTGG
CCTTTGGGCAGTAGAAGGTGGCAATAAACTTGTTTGCTCAGGGCTTCTGCAGGCATCCAAAAG
CAATCTTATATCTGGCTCAGTAATGTACATCGAGGAGAAAACAAAGACCAAGTACACAGGAAA
TCCAACAAAGATGTATGAAGTGGTCTACCAAATTGGAACTGAGACTCGTTCAGACTTCTATGA
CATCGTCTTGGTGGCCACTCCGTTGAATCGAAAAATGTCGAATATTACTTTTCTCAACTTTGA
TCCTCCAATTGAGGAATTCCATCAATATTATCAACATATAGTGACAACTTTAGTTAAGGGGGA
ATTGAATACATCTATCTTTAGCTCTAGACCCATAGATAAATTTGGCCTTAATACAGTTTTAAC
CACTGATAATTCAGATTTGTTCATTAACAGTATTGGGATTGTGCCCTCTGTGAGAGAAAAGGA
AGATCCTGAGCCATCAACAGATGGAACATATGTTTGGAAGATCTTTTCCCAAGAAACTCTTAC
TAAAGCACAAATTTTAAAGCTCTTTCTGTCCTATGATTATGCTGTGAAGAAGCCATGGCTTGC
ATATCCTCACTATAAGCCCCCGGAGAAATGCCCCTCTATCATTCTCCATGATCGACTTTATTA
CCTCAATGGCATAGAGTGTGCAGCAAGTGCCATGGAGATGAGTGCCATTGCAGCCCACAACGC
TGCACTCCTTGCCTATCACCGCTGGAACGGGCACACAGACATGATTGATCAGGATGGCTTATA
TGAGAAACTTAAAACTGAACTATGAAGTGACACACTCCTTTTTCCCCTCCTAGTTCCAAATGA
CTATCAGTGGCAAAAAAGAACAAAATCTGAGCAGAGATGATTTTGAACCAGATATTTTGCCAT
TATCATTGTTTAATAAAAGTAATCCCTGCTGGTCATAGGAAAAAAAAAAAAA

FIGURE 450

</usr/seqdb2/sst/DNA/Dnaseqs.min/ss.DNA62880
<subunit 1 of 1, 505 aa, 1 stop
<MW: 56640, pI: 6.10, NX(S/T): 4
MGRVVAELVSSLLGLWLLLCSCGCPEGAELRAPPDKIAIIGAGIGGTSAAYYLRQKFGKDVKI
DLFEREEVGGRLATMMVQGQEYEAGGSVIHPLNLHMKRFVKDLGLSAVQASGGLLGIYNGETL
VFEESNWFIINVIKLVWRYGFQSLRMHMWVEDVLDKFMRIYRYQSHDYAFSSVEKLLHALGGD
DFLGMLNRTLLETLQKAGFSEKFLNEMIAPVMRVNYGQSTDINAFVGAVSLSCSDSGLWAVEG
GNKLVCSGLLQASKSNLISGSVMYIEEKTKTKYTGNPTKMYEVVYQIGTETRSDFYDIVLVAT
PLNRKMSNITFLNFDPPIEEFHQYYQHIVTTLVKGELNTSIFSSRPIDKFGLNTVLTTDNSDL
FINSIGIVPSVREKEDPEPSTDGTYVWKIFSQETLTKAQILKLFLSYDYAVKKPWLAYPHYKP
PEKCPSIILHDRLYYLNGIECAASAMEMSAIAAHNAALLAYHRWNGHTDMIDQDGLYEKLKTEL

Important features:
Signal peptide:
amino acids 1-23

N-glycosylation sites.
amino acids 196-200, 323-327, 353-357

Tyrosine kinase phosphorylation site.
amino acids 291-298

N-myristoylation sites.
amino acids 23-29, 41-47, 43-49, 45-51, 46-52, 72-78, 115-121, 119-125, 260-266, 384-390, 459-465

Prokaryotic membrane lipoprotein lipid attachment site.
amino acids 12-23, 232-243

FIGURE 451

CAACCATGCAAGGACAGGGCAGGAGAAGAGGAACCTGCAAAGACATATTTTGTTCCAAAATGG
CATCTTACCTTTATGGAGTACTCTTTGCTGTTGGCCTCTGTGCTCCAATCTACTGTGTGTCCC
CGGCCAATGCCCCCAGTGCATACCCCCGCCCTTCCTCCACAAAGAGCACCCCTGCCTCACAGG
TGTATTCCCTCAACACCGACTTTGCCTTCCGCCTATACCGCAGGCTGGTTTTGGAGACCCCGA
GTCAGAACATCTTCTTCTCCCCTGTGAGTGTCTCCACTTCCCTGGCCATGCTCTCCCTTGGGG
CCCACTCAGTCACCAAGACCCAGATTCTCCAGGGCCTGGGCTTCAACCTCACACACACACCAG
AGTCTGCCATCCACCAGGGCTTCCAGCACCTGGTTCACTCACTGACTGTTCCCAGCAAAGACC
TGACCTTGAAGATGGGAAGTGCCCTCTTCGTCAAGAAGGAGCTGCAGCTGCAGGCAAATTTCT
TGGGCAATGTCAAGAGGCTGTATGAAGCAGAAGTCTTTTCTACAGATTTCTCCAACCCCTCCA
TTGCCCAGGCGAGGATCAACAGCCATGTGAAAAAGAAGACCCAAGGGAAGGTTGTAGACATAA
TCCAAGGCCTTGACCTTCTGACGGCCATGGTTCTGGTGAATCACATTTTCTTTAAAGCCAAGT
GGGAGAAGCCCTTTCACCTTGAATATACAAGAAAGAACTTCCCATTCCTGGTGGGCGAGCAGG
TCACTGTGCAAGTCCCCATGATGCACCAGAAAGAGCAGTTCGCTTTTGGGGTGGATACAGAGC
TGAACTGCTTTGTGCTGCAGATGGATTACAAGGGAGATGCCGTGGCCTTCTTTGTCCTCCCTA
GCAAGGGCAAGATGAGGCAACTGGAACAGGCCTTGTCAGCCAGAACACTGATAAAGTGGAGCC
ACTCACTCCAGAAAAGGTGGATAGAGGTGTTCATCCCCAGATTTTCCATTTCTGCCTCCTACA
ATCTGGAAACCATCCTCCCGAAGATGGGCATCCAAAATGCCTTTGACAAAAATGCTGATTTTT
CTGGAATTGCAAAGAGAGACTCCCTGCAGGTTTCTAAAGCAACCCACAAGGCTGTGCTGGATG
TCAGTGAAGAGGGCACTGAGGCCACAGCAGCTACCACCACCAAGTTCATAGTCCGATCGAAGG
ATGGTCCCTCTTACTTCACTGTCTCCTTCAATAGGACCTTCCTGATGATGATTACAAATAAAG
CCACAGACGGTATTCTCTTTCTAGGGAAAGTGGAAAATCCCACTAAATCCTAGGTGGGAAATG
GCCTGTTAACTGATGGCACATTGCTAATGCACAAGAAATAACAAACCACATCCCTCTTTCTGT
TCTGAGGGTGCATTTGACCCCAGTGGAGCTGGATTCGCTGGCAGGGATGCCACTTCCAAGGCT
CAATCACCAAACCATCAACAGGGACCCCAGTCACAAGCCAACACCCATTAACCCCAGTCAGTG
CCCTTTTCCACAAATTCTCCCAGGTAACTAGCTTCATGGGATGTTGCTGGGTTACCATATTTC
CATTCCTTGGGGCTCCCAGGAATGGAAATACGCCAACCCAGGTTAGGCACCTCTATTGCAGAA
TTACAATAACACATTCAATAAAACTAAAATATGAATTCAAAAAAAAAAAAAAAAAAAAAA
AAAAAAAAAAAAAAAAAAAAAAAAAAAAAAAAAAAAAAAA

FIGURE 452

MASYLYGVLFAVGLCAPIYCVSPANAPSAYPRPSSTKSTPASQVYSLNTDFAFRLYRRLVLET
PSQNIFFSPVSVSTSLAMLSLGAHSVTKTQILQGLGFNLTHTPESAIHQGFQHLVHSLTVPSK
DLTLKMGSALFVKKELQLQANFLGNVKRLYEAEVFSTDFSNPSIAQARINSHVKKKTQGKVVD
IIQGLDLLTAMVLVNHIFFKAKWEKPFHLEYTRKNFPFLVGEQVTVQVPMMHQKEQFAFGVDT
ELNCFVLQMDYKGDAVAFFVLPSKGKMRQLEQALSARTLIKWSHSLQKRWIEVFIPRFSISAS
YNLETILPKMGIQNAFDKNADFSGIAKRDSLQVSKATHKAVLDVSEEGTEATAATTTKFIVRS
KDGPSYFTVSFNRTFLMMITNKATDGILFLGKVENPTKS

Signal peptide:
amino acids 1-20

FIGURE 453

CTCCGGGTCCCCAGGGGCTGCGCCGGGCCGGCCTGGCAAGGGGGACGAGTCAGTGGACACTCCAGGAAGAGCGGC
CCCGCGGGGGGCGATGACCGTGCGCTGACCCTGACTCACTCCAGGTCCGGAGGCGGGGGCCCCCGGGGCGACTCG
GGGGCGGACCGCGGGGCGGAGCTGCCGCCCGTGAGTCCGGCCGAGCCACCTGAGCCCGAGCCGCGGGACACCGTC
GCTCCTGCTCTCCGAATGCTGCGCACCGCGATGGGCCTGAGGAGCTGGCTCGCCGCCCCATGGGGCGCGCTGCCG
CCTCGGCCACCGCTGCTGCTGCTCCTGCTGCTGCTGCTCCTGCTGCAGCCGCCGCCTCCGACCTGGGCGCTCAGC
CCCCGGATCAGCCTGCCTCTGGGCTCTGAAGAGCGGCCATTCCTCAGATTCGAAGCTGAACACATCTCCAACTAC
ACAGCCCTTCTGCTGAGCAGGGATGGCAGGACCCTGTACGTGGGTGCTCGAGAGGCCCTCTTTGCACTCAGTAGC
AACCTCAGCTTCCTGCCAGGCGGGGAGTACCAGGAGCTGCTTTGGGGTGCAGACGCAGAGAAGAAACAGCAGTGC
AGCTTCAAGGGCAAGGACCCACAGCGCGACTGTCAAAACTACATCAAGATCCTCCTGCCGCTCAGCGGCAGTCAC
CTGTTCACCTGTGGCACAGCAGCCTTCAGCCCCATGTGTACCTACATCAACATGGAGAACTTCACCCTGGCAAGG
GACGAGAAGGGGAATGTCCTCCTGGAAGATGGCAAGGGCCGTTGTCCCTTCGACCCGAATTTCAAGTCCACTGCC
CTGGTGGTTGATGGCGAGCTCTACACTGGAACAGTCAGCAGCTTCCAAGGGAATGACCCGGCCATCTCGCGGAGC
CAAAGCCTTCGCCCCACCAAGACCGAGAGCTCCCTCAACTGGCTGCAAGACCCAGCTTTTGTGGCCTCAGCCTAC
ATTCCTGAGAGCCTGGGCAGCTTGCAAGGCGATGATGACAAGATCTACTTTTTCTTCAGCGAGACTGGCCAGGAA
TTTGAGTTCTTTGAGAACACCATTGTGTCCCGCATTGCCCGCATCTGCAAGGGCGATGAGGGTGGAGAGCGGGTG
CTACAGCAGCGCTGGACCTCCTTCCTCAAGGCCCAGCTGCTGTGCTCACGGCCCGACGATGGCTTCCCCTTCAAC
GTGCTGCAGGATGTCTTCACGCTGAGCCCCAGCCCCCAGGACTGGCGTGACACCCTTTTCTATGGGGTCTTCACT
TCCCAGTGGCACAGGGGAACTACAGAAGGCTCTGCCGTCTGTGTCTTCACAATGAAGGATGTGCAGAGAGTCTTC
AGCGGCCTCTACAAGGAGGTGAACCGTGAGACACAGCAGTGGTACACCGTGACCCACCCGGTGCCCACACCCCGG
CCTGGAGCGTGCATCACCAACAGTGCCCGGGAAAGGAAGATCAACTCATCCCTGCAGCTCCCAGACCGCGTGCTG
AACTTCCTCAAGGACCACTTCCTGATGGACGGGCAGGTCCGAAGCCGCATGCTGCTGCTGCAGCCCCAGGCTCGC
TACCAGCGCGTGGCTGTACACCGCGTCCCTGGCCTGCACCACACCTACGATGTCCTCTTCCTGGGCACTGGTGAC
GGCCGGCTCCACAAGGCAGTGAGCGTGGGCCCCCGGGTGCACATCATTGAGGAGCTGCAGATCTTCTCATCGGGA
CAGCCCGTGCAGAATCTGCTCCTGGACACCCACAGGGGGCTGCTGTATGCGGCCTCACACTCGGGCGTAGTCCAG
GTGCCCATGGCCAACTGCAGCCTGTACCGGAGCTGTGGGGACTGCCTCCTCGCCCGGGACCCCTACTGTGCTTGG
AGCGGCTCCAGCTGCAAGCACGTCAGCCTCTACCAGCCTCAGCTGGCCACCAGGCCGTGGATCCAGGACATCGAG
GGAGCCAGCGCCAAGGACCTTTGCAGCGCGTCTTCGGTTGTGTCCCCGTCTTTTGTACCAACAGGGGAGAAGCCA
TGTGAGCAAGTCCAGTTCCAGCCCAACACAGTGAACACTTTGGCCTGCCCGCTCCTCTCCAACCTGGCGACCCGA
CTCTGGCTACGCAACGGGGCCCCCGTCAATGCCTCGGCCTCCTGCCACGTGCTACCCACTGGGGACCTGCTGCTG
GTGGGCACCCAACAGCTGGGGGAGTTCCAGTGCTGGTCACTAGAGGAGGGCTTCCAGCAGCTGGTAGCCAGCTAC
TGCCCAGAGGTGGTGGAGGACGGGGTGGCAGACCAAACAGATGAGGGTGGCAGTGTACCCGTCATTATCAGCACA
TCGCGTGTGAGTGCACCAGCTGGTGGCAAGGCCAGCTGGGGTGCAGACAGGTCCTACTGGAAGGAGTTCCTGGTG
ATGTGCACGCTCTTTGTGCTGGCCGTGCTGCTCCCAGTTTTATTCTTGCTCTACCGGCACCGGAACAGCATGAAA
GTCTTCCTGAAGCAGGGGGAATGTGCCAGCGTGCACCCCAAGACCTGCCCTGTGGTGCTGCCCCCTGAGACCCGC
CCACTCAACGGCCTAGGGCCCCCTAGCACCCCGCTCGATCACCGAGGGTACCAGTCCCTGTCAGACAGCCCCCCG
GGGGCCCGAGTCTTCACTGAGTCAGAGAAGAGGCCACTCAGCATCCAAGACAGCTTCGTGGAGGTATCCCCAGTG
TGCCCCCGGCCCCGGGTCCGCCTTGGCTCGGAGATCCGTGACTCTGTGGTGTGAGAGCTGACTTCCAGAGGACGC
TGCCCTGGCTTCAGGGGCTGTGAATGCTCGGAGAGGGTCAACTGGACCTCCCCTCCGCTCTGCTCTTCGTGGAAC
ACGACCGTGGTGCCCGGCCCTTGGGAGCCTTGGAGCCAGCTGGCCTGCTGCTCTCCAGTCAAGTAGCGAAGCTCC
TACCACCCAGACACCCAAACAGCCGTGGCCCCAGAGGTCCTGGCCAAATATGGGGGCCTGCCTAGGTTGGTGGAA
CAGTGCTCCTTATGTAAACTGAGCCCTTTGTTTAAAAAACAATTCCAAATGTGAAACTAGAATGAGAGGGAAGAG
ATAGCATGGCATGCAGCACACACGGCTGCTCCAGTTCATGGCCTCCCAGGGGTGCTGGGGATGCATCCAAAGTGG
TTGTCTGAGACAGAGTTGGAAACCCTCACCAACTGGCCTCTTCACCTTCCACATTATCCCGCTGCCACCGGCTGC
CCTGTCTCACTGCAGATTCAGGACCAGCTTGGGCTGCGTGCGTTCTGCCTTGCCAGTCAGCCGAGGATGTAGTTG
TTGCTGCCGTCGTCCCACCACCTCAGGGACCAGAGGGCTAGGTTGGCACTGCGGCCCTCACCAGGTCCTGGGCTC
GGACCCAACTCCTGGACCTTTCCAGCCTGTATCAGGCTGTGGCCACACGAGAGGACAGCGCGAGCTCAGGAGAGA
TTTCGTGACAATGTACGCCTTTCCCTCAGAATTCAGGGAAGAGACTGTCGCCTGCCTTCCTCCGTTGTTGCGTGA
GAACCCGTGTGCCCCTTCCCACCATATCCACCCTCGCTCCATCTTTGAACTCAAACACGAGGAACTAACTGCACC
CTGGTCCTCTCCCCAGTCCCCAGTTCACCCTCCATCCCTCACCTTCCTCCACTCTAAGGGATATCAACACTGCCC
AGCACAGGGGCCCTGAATTTATGTGGTTTTTATACATTTTTTAATAAGATGCACTTTATGTCATTTTTTAATAAA
GTCTGAAGAATTACTGTTTAAAAAAAAAAAA

FIGURE 454

></usr/seqdb2/sst/DNA/Dnaseqs.min/ss.DNA67962
><subunit 1 of 1, 837 aa, 1 stop
><MW: 92750, pI: 7.04, NX(S/T): 6
MLRTAMGLRSWLAAPWGALPPRPPLLLLLLLLLLLQPPPPTWALSPRISLPLGSEERPFLRFE
AEHISNYTALLLSRDGRTLYVGAREALFALSSNLSFLPGGEYQELLWGADAEKKQQCSFKGKD
PQRDCQNYIKILLPLSGSHLFTCGTAAFSPMCTYINMENFTLARDEKGNVLLEDGKGRCPFDP
NFKSTALVVDGELYTGTVSSFQGNDPAISRSQSLRPTKTESSLNWLQDPAFVASAYIPESLGS
LQGDDDKIYFFFSETGQEFEFFENTIVSRIARICKGDEGGERVLQQRWTSFLKAQLLCSRPDD
GFPFNVLQDVFTLSPSPQDWRDTLFYGVFTSQWHRGTTEGSAVCVFTMKDVQRVFSGLYKEVN
RETQQWYTVTHPVPTPRPGACITNSARERKINSSLQLPDRVLNFLKDHFLMDGQVRSRMLLLQ
PQARYQRVAVHRVPGLHHTYDVLFLGTGDGRLHKAVSVGPRVHIIEELQIFSSGQPVQNLLLD
THRGLLYAASHSGVVQVPMANCSLYRSCGDCLLARDPYCAWSGSSCKHVSLYQPQLATRPWIQ
DIEGASAKDLCSASSVVSPSFVPTGEKPCEQVQFQPNTVNTLACPLLSNLATRLWLRNGAPVN
ASASCHVLPTGDLLLVGTQQLGEFQCWSLEEGFQQLVASYCPEVVEDGVADQTDEGGSVPVII
STSRVSAPAGGKASWGADRSYWKEFLVMCTLFVLAVLLPVLFLLYRHRNSMKVFLKQGECASV
HPKTCPVVLPPETRPLNGLGPPSTPLDHRGYQSLSDSPPGARVFTESEKRPLSIQDSFVEVSP
VCPRPRVRLGSEIRDSVV

Transmembrane domains:
amino acids 23-46 (type II), 718-738

FIGURE 455

TAAGATGAGGGCATCCCTCACGTTCACACCCCTGGTGGCATCTGCCAGCCCTGTTCTGGGGAC
AAGGCGGGCTTTCGTGGGAGCCATGCTCAGCCTGCCAGGAAGCCAAGCCCTACAGTGCAGAGG
AAACAGAATTTCAACGGGAAGCTGGTTTGCTTCATACCATTGGGATCTGCTGGTAAAGCTGTT
ATTTGGGTTTAGGGACTGATCCCTTGCAGTTTACTTCTGGATCACCATGAATGGCCAAGATGG
TGGCAGAACACGCTGTGGACCCTGAGTTAGAGACAATGCAAATGTTGGATTGGGTGTAATTCT
TTTTGAATCCCAGATCCAGTCTGTACTTGAATATGAGCAGAAGATCTACAAGAATGCTGACAG
GGAACCGTGTTAAGACCCAGCACCCCTATTCCCAGGAGCTTCTGGCCTGACCATCTGCAGCCA
AAGCACTAACAGGGACAGATATGGGAATGTCCACCTTTGATCCGCATCCTGCACAATAGTGGT
CCCACCATGGCTGCCACTTTTTTATACTATTTGGAGAAAAGACCTTGTATAAATTCGAGGCCC
GAGTGACTAACGTCTCTGTCACACGGAAATGGGTACTTGGTGGCATAGAGAAACACAATTAGC
CACTTTTTCAGCTACACTTCTCACTCAGCTGCACCCTACACTTCTCACTCAGGTGCACCCCCT
TCTGCTGTCCTTTCCCCAACGTACTGGGTCCCGAGCGTGGTGGGTATTTGCCACACTGGGTGC
CAGCTCAGCAGCCCCCCACCTCTCTTTATTCTCTCCAAAGCTGGTCTTTCTGACTATCATTGT
GGTAGGGGGAGGACAGATGCTAAAGGTGGAAGCTGACCTGGAGAAAGAGACACACGGGGTGAC
TGTGGCAAAGGACAGCTGGAAAAGAAACTCTATCACTTCTTCATTGGCAACCACAAGGCACCC
GAGGCCATGGCACTCCCAGAGGCTGTGCGCAGAGCCAAGCCTCTCAACCTCTTCTGGCCCTGC
GTCCTGCAGCGAAGTCTCTGCTGTAAGACAGTAGACTCCTTCGATGAGGTGCTCAAAAATGCT
ACCCGGGGTGGTGGTGTCTGGCTTGCAGTCTGGCCCAGTTCAGAGAAAGTTGCAGAGATCAGGG
GCCAAGGATGTCATAGCCCCAGGTTGTCCTCAGGGTCCCAATCCTAGGGCAGGGTGTGCATGG
AAGCAAGAACTATGGAAACCTAGCTCCAGTCTGCAGGCTCTGAGCCCCTAGTTCCTCACTCCA
GCGGGGCTCCCTCACTGCACAGAACCCACCCCTTCTGTGTGGGCACTGCTGACCACACAGATG
ACCCAGACCCAAAGAGCCTGGCAGAAGCTCTGTGGTTGGAGCTGGGCTCCGTCTCCAGGTCTG
GTTCAGGGGGATCAGGAAGGCTCTTTTCCACCTGTGGCTTCACTGGCCCTTTGAGATTTCCTA
TCTCACCGTTACTTCAGTTACCCTTGCAGGGGGCCAGGGAGTCAAGAATATACCGTGTTCCTC
CAGGGTTTAAGCCGGCCATGCCTTCCCGAGAGCATAACCAACTTGACAGGGGTGCCCAGTTAC
CCCACAAACTGAAGGAAGGAGATCCTTCCCCCGTCCCCAGGAGTGCTCTCAACCAGCCTCAGA
AAGCTTGAGAAGATGGACCCTTTGCCCACCAGGGTTAATTCCTGGTGGGGCAGCTCGGCTGTG
ATCAGGGCAACCAAACCTATAGGAAGCCTTCCAGTGTGAGCTGGAATTAGACTGAACATGTGC
TTGGGCCTGCCTCTCCCTAGACGCAGTTGCGGGGCACTCCAGGGAATGAACCAGCTCAAGTGT
GTCCCTAACAGCAGCCTGGAGCTACCCCCAATCCCTCACAGCCTGACCCTCCTCATTCCATCA
GATCTCGTGCCG

FIGURE 456

></usr/seqdb2/sst/DNA/Dnaseqs.min/ss.DNA69555
><subunit 1 of 1, 148 aa, 1 stop
><MW: 16214, pI: 10.22, NX(S/T): 0

MGTWWHRETQLATFSATLLTQLHPTLLTQVHPLLLSFPQRTGSRAWWVFATLGASSAAPH
LSLFSPKLVFLTIIVVGGGQMLKVEADLEKETHGVTVAKDSWKRNSITSSLATTRHPRPW
HSQRLCAEPSLSTSSGPASCSEVSAVRQ

Important features of the protein:
Signal peptide:
Amino acids 1-28

Transmembrane domain:
Amino acids 64-78 cAMP- and cGMP-dependent protein kinase phosphorylation site:
Amino acids 103-107

N-myristoylation sites:
Amino acids 53-59;94-100

FIGURE 457

CCCGCGCGCCCCTGGCACTCAATCCCCGCCATGTGGGGGCTCCTGCTCGCCCTGGCCGCCTTC
GCGCCGGCCGTCGGCCCGGCTCTGGGGGCGCCCAGGAACTCGGTGCTGGGCCTCGCGCAGCCC
GGGACCACCAAGGTCCCAGGCTCGACCCCGGCCCTGCATAGCAGCCCGGCACAGCCGCCGGCG
GAGACAGCTAACGGGACCTCAGAACAGCATGTCCGGATTCGAGTCATCAAGAAGAAAAAGGTC
ATTATGAAGAAGCGGAAGAAGCTAACTCTAACTCGCCCCACCCCACTGGTGACTGCCGGGCCC
CTTGTGACCCCCACTCCAGCAGGGACCCTCGACCCCGCTGAGAAACAAGAAACAGGCTGTCCT
CCTTTGGGTCTGGAGTCCCTGCGAGTTTCAGATAGCCGGCTTGAGGCATCCAGCAGCCAGTCC
TTTGGTCTTGGACCACACCGAGGACGGCTCAACATTCATTCAGGCCTGGAGGACGGCGATCTA
TATGATGGAGCCTGGTGTGCTGAGGAGCAGGACGCCGATCCATGGTTTCAGGTGGACGCTGGG
CACCCCACCCGCTTCTCGGGTGTTATCACACAGGGCAGGAACTCTGTCTGGAGGTATGACTGG
GTCACATCATACAAGGTCCAGTTCAGCAATGACAGTCGGACCTGGTGGGGAAGTAGGAACCAC
AGCAGTGGGATGGACGCAGTATTTCCTGCCAATTCAGACCCAGAAACTCCAGTGCTGAACCTC
CTGCCGGAGCCCCAGGTGGCCCGCTTCATTCGCCTGCTGCCCCAGACCTGGCTCCAGGGAGGC
GCGCCTTGCCTCCGGGCAGAGATCCTGGCCTGCCCAGTCTCAGACCCCAATGACCTATTCCTT
GAGGCCCCTGCGTCGGGATCCTCTGACCCTCTAGACTTTCAGCATCACAATTACAAGGCCATG
AGGAAGCTGATGAAGCAGGTACAAGAGCAATGCCCCAACATCACCCGCATCTACAGCATTGGG
AAGAGCTACCAGGGCCTGAAGCTGTATGTGATGGAAATGTCGGACAAGCCTGGGGAGCATGAG
CTGGGGGAGCCTGAGGTGCGCTACGTGGCTGGCATGCATGGGAACGAGGCCCTGGGGCGGGAG
TTGCTTCTGCTCCTGATGCAGTTCCTGTGCCATGAGTTCCTGCGAGGGAACCCACGGGTGACC
CGGCTGCTCTCTGAGATGCGCATTCACCTGCTGCCCTCCATGAACCCTGATGGCTATGAGATC
GCCTACCACCGGGGTTCAGAGCTGGTGGGCTGGGCCGAGGGCCGCTGGAACAACCAGAGCATC
GATCTTAACCATAATTTTGCTGACCTCAACACACCACTGTGGGAAGCACAGGACGATGGGAAG
GTGCCCCACATCGTCCCCAACCATCACCTGCCATTGCCCACTTACTACACCCTGCCCAATGCC
ACCGTGGCTCCTGAAACGCGGGCAGTAATCAAGTGGATGAAGCGGATCCCCTTTGTGCTAAGT
GCCAACCTCCACGGGGGTGAGCTCGTGGTGTCCTACCCATTCGACATGACTCGCACCCCGTGG
GCTGCCCGCGAGCTCACGCCCACACCAGATGATGCTGTGTTTCGCTGGCTCAGCACTGTCTAT
GCTGGCAGTAATCTGGCCATGCAGGACACCAGCCGCCGACCCTGCCACAGCCAGGACTTCTCC
GTGCACGGCAACATCATCAACGGGGCTGACTGGCACACGGTCCCCGGGAGCATGAATGACTTC
AGCTACCTACACACCAACTGCTTTGAGGTCACTGTGGAGCTGTCCTGTGACAAGTTCCCTCAC
GAGAATGAATTGCCCCAGGAGTGGGAGAACAACAAAGACGCCCTCCTCACCTACCTGGAGCAG
GTGCGCATGGGCATTGCAGGAGTGGTGAGGGACAAGGACACGGAGCTTGGGATTGCTGACGCT
GTCATTGCCGTGGATGGGATTAACCATGACGTGACCACGGCGTGGGGCGGGGATTATTGGCGT
CTGCTGACCCCAGGGGACTACATGGTGACTGCCAGTGCCGAGGGCTACCATTCAGTGACACGG
AACTGTCGGGTCACCTTTGAAGAGGGCCCCTTCCCCTGCAATTTCGTGCTCACCAAGACTCCC
AAACAGAGGCTGCGCGAGCTGCTGGCAGCTGGGGCCAAGGTGCCCCCGGACCTTCGCAGGCGC
CTGGAGCGGCTAAGGGGACAGAAGGATTGATACCTGCGGTTTAAGAGCCCTAGGGCAGGCTGG
ACCTGTCAAGACGGGAAGGGGAAGAGTAGAGAGGGAGGGACAAAGTGAGGAAAAGGTGCTCAT
TAAAGCTACCGGGCACCTTAAAAAAAAAAAAAAAAAAAAAAAAAAAAAAAAAAAAA

FIGURE 458

></usr/seqdb2/sst/DNA/Dnaseqs.min/ss.DNA71162
><subunit 1 of 1, 734 aa, 1 stop
><MW: 81677, pI: 6.60, NX(S/T): 6
MWGLLLALAAFAPAVGPALGAPRNSVLGLAQPGTTKVPGSTPALHSSPAQPPAETANGTS
EQHVRIRVIKKKKVIMKKRKKLTLTRPTPLVTAGPLVTPTPAGTLDPAEKQETGCPPLGL
ESLRVSDSRLEASSSQSFGLGPHRGRLNIHSGLEDGDLYDGAWCAEEQDADPWFQVDAGH
PTRFSGVITQGRNSVWRYDWVTSYKVQFSNDSRTWWGSRNHSSGMDAVFPANSDPETPVL
NLLPEPQVARFIRLLPQTWLQGGAPCLRAEILACPVSDPNDLFLEAPASGSSDPLDFQHH
NYKAMRKLMKQVQEQCPNITRIYSIGKSYQGLKLYVMEMSDKPGEHELGEPEVRYVAGMH
GNEALGRELLLLLMQFLCHEFLRGNPRVTRLLSEMRIHLLPSMNPDGYEIAYHRGSELVG
WAEGRWNNQSIDLNHNFADLNTPLWEAQDDGKVPHIVPNHHLPLPTYYTLPNATVAPETR
AVIKWMKRIPFVLSANLHGGELVVSYPFDMTRTPWAARELTPTPDDAVFRWLSTVYAGSN
LAMQDTSRRPCHSQDFSVHGNIINGADWHTVPGSMNDFSYLHTNCFEVTVELSCDKFPHE
NELPQEWENNKDALLTYLEQVRMGIAGVVRDKDTELGIADAVIAVDGINHDVTTAWGGDY
WRLLTPGDYMVTASAEGYHSVTRNCRVTFEEGPFPCNFVLTKTPKQRLRELLAAGAKVPP
DLRRRLERLRGQKD

FIGURE 459

TAAAACAGCTACAATATTCCAGGGCCAGTCACTTGCCATTTCTCATAACAGCGTCAGAGAGAA
AGAACTGACTGAAACGTTTGAGATGAAGAAAGTTCTCCTCCTGATCACAGCCATCTTGGCAGT
GGCTGTTGGTTTCCCAGTCTCTCAAGACCAGGAACGAGAAAAAAGAAGTATCAGTGACAGCGA
TGAATTAGCTTCAGGGTTTTTTGTGTTCCCTTACCCATATCCATTTCGCCCACTTCCACCAAT
TCCATTTCCAAGATTTCCATGGTTTAGACGTAATTTTCCTATTCCAATACCTGAATCTGCCCC
TACAACTCCCCTTCCTAGCGAAAAGTAAACAAGAAGGATAAGTCACGATAAACCTGGTCACCT
GAAATTGAAATTGAGCCACTTCCTTGAAGAATCAAAATTCCTGTTAATAAAAGAAAAACAAAT
GTAATTGAAATAGCACACAGCATTCTCTAGTCAATATCTTTAGTGATCTTCTTTAATAAACAT
GAAAGCAAAGATTTTGGTTTCTTAATTTCCACA

FIGURE 460

></usr/seqdb2/sst/DNA/Dnaseqs.min/ss.DNA71290
><subunit 1 of 1, 85 aa, 1 stop
><MW: 9700, pI: 9.55, NX(S/T): 0
MKKVLLLITAILAVAVGFPVSQDQEREKRSISDSDELASGFFVFPYPYPFRPLPPIPFPRFPW
FRRNFPIPIPESAPTTPLPSEK

Important features of the protein:
Signal peptide:
amino acids 1-17

Homologous region to B3-hordein:
amino acids 47-85

Important features of the protein:
Signal peptide:
Amino acids 1-20

N-glycosylation sites:
Amino acids 57-61;210-214;220-224;318-322;428-432;472-476 cAMP- and cGMP-dependent protein kinase phosphorylation site:
Amino acids 80-84

N-myristoylation sites:
Amino acids 3-9;20-29;39-48;152-161;161-170;262-271;358-364;
538-544;560-566;637-643

Zinc carboxypeptidases, zinc-binding region 2 signature:
Amino acids 498-509

Zinc carboxypeptidases:
Amino acids 391-411

FIGURE 461

```
AGCAGGAGCAGGAGAGGGACAATGGAAGCTGCCCCGTCCAGGTTCATGTTCCTCTTATTTCTC
CTCACGTGTGAGCTGGCTGCAGAAGTTGCTGCAGAAGTTGAGAAATCCTCAGATGGTCCTGGT
GCTGCCCAGGAACCCACGTGGCTCACAGATGTCCCAGCTGCCATGGAATTCATTGCTGCCACT
GAGGTGGCTGTCATAGGCTTCTTCCAGGATTTAGAAATACCAGCAGTGCCCATACTCCATAGC
ATGGTGCAAAAATTCCCAGGCGTGTCATTTGGGATCAGCACTGATTCTGAGGTTCTGACACAC
TACAACATCACTGGGAACACCATCTGCCTCTTTCGCCTGGTAGACAATGAACAACTGAATTTA
GAGGACGAAGACATTGAAAGCATTGATGCCACCAAATTGAGCCGTTTCATTGAGATCAACAGC
CTCCACATGGTGACAGAGTACAACCCTGTGACTGTGATTGGGTTATTCAACAGCGTAATTCAG
ATTCATCTCCTCCTGATAATGAACAAGGCCTCCCCAGAGTATGAAGAGAACATGCACAGATAC
CAGAAGGCAGCCAAGCTCTTCCAGGGGAAGATTCTCTTTATTCTGGTGGACAGTGGTATGAAA
GAAAATGGGAAGGTGATATCATTTTTCAAACTAAAGGAGTCTCAACTGCCAGCTTTGGCAATT
TACCAGACTCTAGATGACGAGTGGGATACACTGCCCACAGCAGAAGTTTCCGTAGAGCATGTG
CAAAACTTTTGTGATGGATTCCTAAGTGGAAAATTGTTGAAAGAAAATCGTGAATCAGAAGGA
AAGACTCCAAAGGTGGAACTCTGACTTCTCCTTGGAACTACATATGGCCAAGTATCTACTTTA
TGCAAAGTAAAAAGGCACAACTCAAATCTCAGAGACACTAAACAACAGGATCACTAGGCCTGC
CAACCACACACACACGCACGTGCACACACGCACGCACGCGTGCACACACACACGCGCACACAC
ACACACACACAGAGCTTCATTTCCTGTCTTAAAATCTCGTTTTCTCTTCTTCCTTCTTTTAAA
TTTCATATCCTCACTCCCTATCCAATTTCCTTCTTATCGTGCATTCATACTCTGTAAGCCCAT
CTGTAACACACCTAGATCAAGGCTTTAAGAGACTCACTGTGATGCCTCTATGAAAGAGAGGCA
TTCCTAGAGAAAGATTGTTCCAATTTGTCATTTAATATCAAGTTTGTATACTGCACATGACTT
ACACACAACATAGTTCCTGCTCTTTTAAGGTTACCTAAGGGTTGAAACTCTACCTTCTTTCAT
AAGCACATGTCCGTCTCTGACTCAGGATCAAAAACCAAAGGATGGTTTTAAACACCTTTGTGA
AATTGTCTTTTTGCCAGAAGTTAAAGGCTGTCTCCAAGTCCCTGAACTCAGCAGAAATAGACC
ATGTGAAAACTCCATGCTTGGTTAGCATCTCCAACTCCCTATGTAAATCAACAACCTGCATAA
TAAATAAAAGGCAATCATGTTATA
```

FIGURE 462

></usr/seqdb2/sst/DNA/Dnaseqs.min/ss.DNA76401
><subunit 1 of 1, 273 aa, 1 stop
><MW: 30480, pI: 4.60, NX(S/T): 1
MEAAPSRFMFLLFLLTCELAAEVAAEVEKSSDGPGAAQEPTWLTDVPAAMEFIAATEVAVIGF
FQDLEIPAVPILHSMVQKFPGVSFGISTDSEVLTHYNITGNTICLFRLVDNEQLNLEDEDIES
IDATKLSRFIEINSLHMVTEYNPVTVIGLFNSVIQIHLLLIMNKASPEYEENMHRYQKAAKLF
QGKILFILVDSGMKENGKVISFFKLKESQLPALAIYQTLDDEWDTLPTAEVSVEHVQNFCDGF
LSGKLLKENRESEGKTPKVEL

Signal peptide:
amino acids 1-20

Transmembrane domain:
amino acids 143-162

FIGURE 463

CTCGCTTCTTCCTTCTGGATGGGGGCCCAGGGGGCCCAGGAGAGTATAAAGGCGATGTGGAGG
GTGCCCGGCACAACCAGACGCCCAGTCACAGGCGAGAGCCCTGGGATGCACCGGCCAGAGGCC
ATGCTGCTGCTGCTCACGCTTGCCCTCCTGGGGGCCCCACCTGGGCAGGGAAGATGTATGGC
CCTGGAGGAGGCAAGTATTTCAGCACCACTGAAGACTACGACCATGAAATCACAGGGCTGCGG
GTGTCTGTAGGTCTTCTCCTGGTGAAAAGTGTCCAGGTGAAACTTGGAGACTCCTGGGACGTG
AAACTGGGAGCCTTAGGTGGGAATACCCAGGAAGTCACCCTGCAGCCAGGCGAATACATCACA
AAAGTCTTTGTCGCCTTCCAAGCTTTCCTCCGGGGTATGGTCATGTACACCAGCAAGGACCGC
TATTTCTATTTTGGGAAGCTTGATGGCCAGATCTCCTCTGCCTACCCCAGCCAAGAGGGGCAG
GTGCTGGTGGGCATCTATGGCCAGTATCAACTCCTTGGCATCAAGAGCATTGGCTTTGAATGG
AATTATCCACTAGAGGAGCCGACCACTGAGCCACCAGTTAATCTCACATACTCAGCAAACTCA
CCCGTGGGTCGCTAGGGTGGGGTATGGGGCCATCCGAGCTGAGGCCATCTGTGTGGTGGTGGC
TGATGGTACTGGAGTAACTGAGTCGGGACGCTGAATCTGAATCCACCAATAAATAAAGCTTCT
GCAGAAAA

FIGURE 464

></usr/seqdb2/sst/DNA/Dnaseqs.min/ss.DNA76541
><subunit 1 of 1, 178 aa, 1 stop
><MW: 19600, pI: 5.89, NX(S/T): 1
MHRPEAMLLLLTLALLGGPTWAGKMYGPGGGKYFSTTEDYDHEITGLRVSVGLLLVKSVQVKL
GDSWDVKLGALGGNTQEVTLQPGEYITKVFVAFQAFLRGMVMYTSKDRYFYFGKLDGQISSAY
PSQEGQVLVGIYGQYQLLGIKSIGFEWNYPLEEPTTEPPVNLTYSANSPVGR

Signal peptide:
amino acids 1-22

FIGURE 465

CGGACGCGTGGGTCCGGCGGCCTGAGGCTGCACCGGGCACGGGTCGGCCGCAATCCAGCCTGGGCGGAGCCGGAG
TTGCGAGCCGCTGCCTAGAGGCCGAGGAGCTCACAGCTATGGGCTGGAGGCCCCGGAGAGCTCGGGGGACCCCGT
TGCTGCTGCTGCTACTACTGCTGCTGCTCTGGCCAGTGCCAGGCGCCGGGGTGCTTCAAGGACATATCCCTGGGC
AGCCAGTCACCCCGCACTGGGTCCTGGATGGACAACCCTGGCGCACCGTCAGCCTGGAGGAGCCGGTCTCGAAGC
CAGACATGGGGCTGGTGGCCCTGGAGGCTGAAGGCCAGGAGCTCCTGCTTGAGCTGGAGAAGAACCACAGGCTGC
TGGCCCCAGGATACATAGAAACCCACTACGGCCCAGATGGGCAGCCAGTGGTGCTGGCCCCCAACCACACGGATC
ATTGCCACTACCAAGGGCGAGTAAGGGGCTTCCCCGACTCCTGGGTAGTCCTCTGCACCTGCTCTGGGATGAGTG
GCCTGATCACCCTCAGCAGGAATGCCAGCTATTATCTGCGTCCCTGGCCACCCCGGGGCTCCAAGGACTTCTCAA
CCCACGAGATCTTTCGGATGGAGCAGCTGCTCACCTGGAAAGGAACCTGTGGCCACAGGGATCCTGGGAACAAAG
CGGGCATGACCAGCCTTCCTGGTGGTCCCCAGAGCAGGGGCAGGCGAGAAGCGCGCAGGACCCGGAAGTACCTGG
AACTGTACATTGTGGCAGACCACACCCTGTTCTTGACTCGGCACCGAAACTTGAACCACACCAAACAGCGTCTCC
TGGAAGTCGCCAACTACGTGGACCAGCTTCTCAGGACTCTGGACATTCAGGTGGCGCTGACCGGCCTGGAGGTGT
GGACCGAGCGGGACCGCAGCCGCGTCACGCAGGACGCCAACGCCACGCTCTGGGCCTTCCTGCAGTGGCGCCGGG
GGCTGTGGGCGCAGCGGCCCCACGACTCCGCGCAGCTGCTCACGGGCCGCGCCTTCCAGGGCGCCACAGTGGGCC
TGGCGCCCGTCGAGGGCATGTGCCGCGCCGAGAGCTCGGGAGGCGTGAGCACGGACCACTCGGAGCTCCCCATCG
GCGCCGCAGCCACCATGGCCCATGAGATCGGCCACAGCCTCGGCCTCAGCCACGACCCCGACGGCTGCTGCGTGG
AGGCTGCGGCCGAGTCCGGAGGCTGCGTCATGGCTGCGGCCACCGGGCACCCGTTTCCGCGCGTGTTCAGCGCCT
GCAGCCGCCGCCAGCTGCGCGCCTTCTTCCGCAAGGGGGGCGGCGCTTGCCTCTCCAATGCCCCGGACCCCGGAC
TCCCGGTGCCGCCGGCGCTCTGCGGGAACGGCTTCGTGGAAGCGGGCGAGGAGTGTGACTGCGGCCCTGGCCAGG
AGTGCCGCGACCTCTGCTGCTTTGCTCACAACTGCTCGCTGCGCCCGGGGGCCCAGTGCGCCCACGGGGACTGCT
GCGTGCGCTGCCTGCTGAAGCCGGCTGGAGCGCTGTGCCGCCAGGCCATGGGTGACTGTGACCTCCCTGAGTTTT
GCACGGGCACCTCCTCCCACTGTCCCCCAGACGTTTACCTACTGGACGGCTCACCCTGTGCCAGGGGCAGTGGCT
ACTGCTGGGATGGCGCATGTCCCACGCTGGAGCAGCAGTGCCAGCAGCTCTGGGGGCCTGGCTCCCACCCAGCTC
CCGAGGCCTGTTTCCAGGTGGTGAACTCTGCGGGAGATGCTCATGGAAACTGCGGCCAGGACAGCGAGGGCCACT
TCCTGCCCTGTGCAGGGAGGGATGCCCTGTGTGGGAAGCTGCAGTGCCAGGGTGGAAAGCCCAGCCTGCTCGCAC
CGCACATGGTGCCAGTGGACTCTACCGTTCACCTAGATGGCCAGGAAGTGACTTGTCGGGGAGCCTTGGCACTCC
CCAGTGCCCAGCTGGACCTGCTTGGCCTGGGCCTGGTAGAGCCAGGCACCCAGTGTGGACCTAGAATGGTGTGCC
AGAGCAGGCGCTGCAGGAAGAATGCCTTCCAGGAGCTTCAGCGCTGCCTGACTGCCTGCCACAGCCACGGGGTTT
GCAATAGCAACCATAACTGCCACTGTGCTCCAGGCTGGGCTCCACCCTTCTGTGACAAGCCAGGCTTTGGTGGCA
GCATGGACAGTGGCCCTGTGCAGGCTGAAAACCATGACACCTTCCTGCTGGCCATGCTCCTCAGCGTCCTGCTGC
CTCTGCTCCCAGGGGCCGGCCTGGCCTGGTGTTGCTACCGACTCCCAGGAGCCCATCTGCAGCGATGCAGCTGGG
GCTGCAGAAGGGACCCTGCGTGCAGTGGCCCCAAAGATGGCCCACACAGGGACCACCCCCTGGGCGGCGTTCACC
CCATGGAGTTGGGCCCCACAGCCACTGGACAGCCCTGGCCCCTGGACCCTGAGAACTCTCATGAGCCCAGCAGCC
ACCCTGAGAAGCCTCTGCCAGCAGTCTCGCCTGACCCCCAAGCAGATCAAGTCCAGATGCCAAGATCCTGCCTCT
GGTGAGAGGTAGCTCCTAAAATGAACAGATTTAAAGACAGGTGGCCACTGACAGCCACTCCAGGAACTTGAACTG
CAGGGGCAGAGCCAGTGAATCACCGGACCTCCAGCACCTGCAGGCAGCTTGGAAGTTTCTTCCCCGAGTGGAGCT
TCGACCCACCCACTCCAGGAACCCAGAGCCACATTAGAAGTTCCTGAGGGCTGGAGAACACTGCTTGGGCACACT
CTCCAGCTCAATAAACCATCAGTCCCAGAAGCAAAGGTCACACAGCCCCTGACCTCCCTCACCAGTGGAGGCTGG
GTAGTGCTGGCCATCCCAAAAGGGCTCTGTCCTGGGAGTCTGGTGTGTCTCCTACATGCAATTTCCACGGACCCA
GCTCTGTGGAGGGCATGACTGCTGGCCAGAAGCTAGTGGTCCTGGGGCCCTATGGTTCGACTGAGTCCACACTCC
CCTGCAGCCTGGCTGGCCTCTGCAAACAAACATAATTTTGGGGACCTTCCTTCCTGTTTCTTCCCACCCTGTCTT
CTCCCCTAGGTGGTTCCTGAGCCCCCACCCCCAATCCCAGTGCTACACCTGAGGTTCTGGAGCTCAGAATCTGAC
AGCCTCTCCCCCATTCTGTGTGTGTCCGGGGGACAGAGGGAACCATTTAAGAAAAGATACCAAAGTAGAAGTCAA
AAGAAAGACATGTTGGCTATAGGCGTGGTGGCTCATGCCTATAATCCCAGCACTTTGGGAAGCCGGGGTAGGAGG
ATCACCAGAGGCCAGCAGGTCCACACCAGCCTGGGCAACACAGCAAGACACCGCATCTACAGAAAAATTTTAAAA
TTAGCTGGGCGTGGTGGTGTGTACCTGTAGGCCTAGCTGCTCAGGAGGCTGAAGCAGGAGGATCACTTGAGCCTG
AGTTCAACACTGCAGTGAGCTATGGTGGCACCACTGCACTCCAGCCTGGGTGACAGAGCAAGACCCTGTCTCTAA
AATAAATTTTAAAAGGACTTAAAAAAAAAAAAAAAAAAAAAAAAAAAAAAAAAAGAAAA

FIGURE 466

```
></usr/seqdb2/sst/DNA/Dnaseqs.min/ss.DNA76788
><subunit 1 of 1, 813 aa, 1 stop
><MW: 87739, pI: 6.94, NX(S/T): 5

MGWRPRRARGTPLLLLLLLLLLWPVPGAGVLQGHIPGQPVTPHWVLDGQPWRTVSLEEPVSKPDMGLVALEAEGQ
ELLLELEKNHRLLAPGYIETHYGPDGQPVVLAPNHTDHCHYQGRVRGFPDSWVVLCTCSGMSGLITLSRNASYYL
RPWPPRGSKDFSTHEIFRMEQLLTWKGTCGHRDPGNKAGMTSLPGGPQSRGRREARRTRKYLELYIVADHTLFLT
RHRNLNHTKQRLLEVANYVDQLLRTLDIQVALTGLEVWTERDRSRVTQDANATLWAFLQWRRGLWAQRPHDSAQL
LTGRAFQGATVGLAPVEGMCRAESSGGVSTDHSELPIGAAATMAHEIGHSLGLSHDPDGCCVEAAAESGGCVMAA
ATGHPFPRVFSACSRRQLRAFFRKGGGACLSNAPDPGLPVPPALCGNGFVEAGEECDCGPGQECRDLCCFAHNCS
LRPGAQCAHGDCCVRCLLKPAGALCRQAMGDCDLPEFCTGTSSHCPPDVYLLDGSPCARGSGYCWDGACPTLEQQ
CQQLWGPGSHPAPEACFQVVNSAGDAHGNCGQDSEGHFLPCAGRDALCGKLQCQGGKPSLLAPHMVPVDSTVHLD
GQEVTCRGALALPSAQLDLLGLGLVEPGTQCGPRMVCQSRRCRKNAFQELQRCLTACHSHGVCNSNHNCHCAPGW
APPFCDKPGFGGSMDSGPVQAENHDTFLLAMLLSVLLPLLPGAGLAWCCYRLPGAHLQRCSWGCRRDPACSGPKD
GPHRDHPLGGVHPMELGPTATGQPWPLDPENSHEPSSHPEKPLPAVSPDPQADQVQMPRSCLW
```

Important features of the protein:
Signal peptide:
Amino acids 1-27

Transmembrane domain:
Amino acids 702-720

N-glycosylation sites:
Amino acids 109-113;145-149;231-235;276-280;448-452

Tyrosine kinase phosphorylation site:
Amino acids 236-244

N-myristoylation sites:
Amino acids 29-35;185-191;195-201;308-314;318-324;326-332;338-344;370-376;
400-406;402-408;454-460;504-510;510-516;517-523;580-586;
601-607;661-667;687-693;717-723;719-725

Amidation site:
Amino acids 200-204

Neutral zinc metallopeptidases, zinc-binding region signature:
Amino acids 342-352

FIGURE 467

CGGCCAGGGCGCCGACAGCCCGACCTCACCAGGAGAACATGCAGCTCGGCACTGGGCTCCTGC
TGGCCGCCGTCCTGAGCCTGCAGCTGGCTGCAGCCGAAGCCATATGGTGTCACCAGTGCACGG
GCTTCGGAGGGTGCTCCCATGGATCCAGATGCCTGAGGGACTCCACCCACTGTGTCACCACTG
CCACCCGGGTCCTCAGCAACACCGAGGATTTGCCTCTGGTCACCAAGATGTGCCACATAGGCT
GCCCCGATATCCCCAGCCTGGGCCTGGGCCCCTACGTATCCATCGCTTGCTGCCAGACCAGCC
TCTGCAACCATGACTGACGGCTGCCCTCCTCCAGGCCCCCGGACGCTCAGCCCCCACAGCCCC
CACAGCCTGGCGCCAGGGCTCACGGCCGCCCCTCCCTCGAGACTGGCCAGCCCACCTCTCCCG
GCCTCTGCAGCCACCGTCCAGCACCGCTTGTCCTAGGGAAGTCCTGCGTGGAGTCTTGCCTCA
ATCTGCTGCCGTCCAAGCCTGGGGCCCATCGTGCCTGCCGCCCCTTCAGGTCCCGACCTCCCC
ACAATAAAATGTGATTGGATCGTGTGGTACAAAAAAAAAAAAAAAAAAAAAAAAAAAAAA
AAAAAAAAAAAAAAAAAAAAAAAAAAAAA

FIGURE 468

></usr/seqdb2/sst/DNA/Dnaseqs.min/ss.DNA77623
><subunit 1 of 1, 97 aa, 1 stop
><MW: 10160, pI: 6.56, NX(S/T): 0
MQLGTGLLLAAVLSLQLAAAEAIWCHQCTGFGGCSHGSRCLRDSTHCVTTATRVLSNTEDLPL
VTKMCHIGCPDIPSLGLGPYVSIACCQTSLCNHD

Important features of the protein:
Signal peptide:
amino acids 1-20

N-myristoylation sites.
amino acids 6-11 and 33-38

Prokaryotic membrane lipoprotein lipid attachment sites.
amino acids 24-34 and 78-88

FIGURE 469

CATGGAGCCTCTTGCAGCTTACCCGCTAAAATGTTCCGGGCCCAGAGCAAAGGTATTTGCAGT
TTTGCTGTCTATAGTTCTATGCACAGTAACGCTATTTCTTCTACAACTAAAATTCCTCAAACC
TAAAATCAACAGCTTTTATGCCTTTGAAGTGAAGGATGCAAAAGGAAGAACTGTTTCTCTGGA
AAAGTATAAAGGCAAAGTTTCACTAGTTGTAAACGTGGCCAGTGACTGCCAACTCACAGACAG
AAATTACTTAGGGCTGAAGGAACTGCACAAAGAGTTTGGACCATCCCACTTCAGCGTGTTGGC
TTTTCCCTGCAATCAGTTTGGAGAATCGGAGCCCCGCCCAAGCAAGGAAGTAGAATCTTTTGC
AAGAAAAAACTACGGAGTAACTTTCCCCATCTTCCACAAGATTAAGATTCTAGGATCTGAAGG
AGAACCTGCATTTAGATTTCTTGTTGATTCTTCAAAGAAGGAACCAAGGTGGAATTTTTGGAA
GTATCTTGTCAACCCTGAGGGTCAAGTTGTGAAGTTCTGGAGGCCAGAGGAGCCCATTGAAGT
CATCAGGCCTGACATAGCAGCTCTGGTTAGACAAGTGATCATAAAAAAGAAAGAGGATCTATG
AGAATGCCATTGCGTTTCTAATAGAACAGAGAAATGTCTCCATGAGGGTTTGGTCTCATTTTA
AACATTTTTTTTTGGAGACAGTGTCTCACTCTGTCACCCAGGCTGGAGTGCAGTAGTGCGTT
CTCAGCTCATTGCAACCTCTGCCTTTTTAAACATGCTATTAAATGTGGCAATGAAGGATTTTT
TTTTAATGTTATCTTGCTATTAAGTGGTAATGAATGTTCCCAGGATGAGGATGTTACCCAAAG
CAAAAATCAAGAGTAGCCAAAGAATCAACATGAAATATATTAACTACTTCCTCTGACCATACT
AAAGAATTCAGAATACACAGTGACCAATGTGCCTCAATATCTTATTGTTCAACTTGACATTTT
CTAGGACTGTACTTGATGAAAATGCCAACACACTAGACCACTCTTTGGATTCAAGAGCACTGT
GTATGACTGAAATTTCTGGAATAACTGTAAATGGTTATGTTAATGGAATAAAACACAAATGTT
GAAAAATGTAAAATATATATACATAGATTCAAATCCTTATATATGTATGCTTGTTTTGTGTAC
AGGATTTTGTTTTTTCTTTTTAAGTACAGGTTCCTAGTGTTTTACTATAACTGTCACTATGTA
TGTAACTGACATATATAAATAGTCATTTATAAATGACCGTATTATAACATTTGAAAAAGTCTT
CATCAAAAAAAAAAAAAAA

FIGURE 470

></usr/seqdb2/sst/DNA/Dnaseqs.min/ss.DNA80136
><subunit 1 of 1, 209 aa, 1 stop
><MW: 23909, pI: 9.68, NX(S/T): 0
MEPLAAYPLKCSGPRAKVFAVLLSIVLCTVTLFLLQLKFLKPKINSFYAFEVKDAKGRTVSLE
KYKGKVSLVVNVASDCQLTDRNYLGLKELHKEFGPSHFSVLAFPCNQFGESEPRPSKEVESFA
RKNYGVTFPIFHKIKILGSEGEPAFRFLVDSSKKEPRWNFWKYLVNPEGQVVKFWRPEEPIEV
IRPDIAALVRQVIIKKKEDL

Important features of the protein:
Signal peptide:
amino acids 1-31

Glutathione peroxidases signature 2.
amino acids 104-112

Glutathione peroxidases.
amino acids 57-82

FIGURE 471

GCCCTAACCTTCCCAGGGCTCAGCTCTTTGGAGCTGCCCATTCCTCCGGCTGCGAGAAAGGACGCGCGCCCTGCG
TCGGGCGAAGAAAAGAAGCAAAACTTGTCGGGAGGGTTTCGTCATCAACCTCCTTCCCGCAAACCTAAACCTCCT
GCCGGGGCCATCCCTAGACAGAGGAAAGTTCCTGCAGAGCCGACCAGCCCTAGTGGATCTGGGGCAGGCAGCGGC
GCTGGCTGTGGAATTAGATCTGTTTTGAACCCAGTGGAGCGCATCGCTGGGGCTCGGAAGTCACCGTCCGCGGGC
ACCGGGTTGGCGCTGCCCGAGTGGAACCGACAGTTTGCGAGCCTCGGCTGCAAGTGGCCTCTCCTCCCCGCGGTT
GTTGTTCAGTGTCGGGTGAGGGCTGCGAGTGTGGCAAGTTGCAAAGAGAGCCTCAGAGGTCCGAAGAGCGCTGCG
CTCCTACTCGCGTTCGCTTCTTCCTCTTCTCGGTTCCCTACTGTGAAATCGCAGCGACATTTACAAAGGCCTCCG
GGTCCTACCGAGACCGATCCGCAGCGTTTGGCCCGGTCGTGCCTATTGCATCGGGAGCCCCCGAGCACCGGCGAA
GGACTGGCGGGTGGGGTAGGGAGGTGGCGGCGGCGGCATGGCGAGGTTCCCGAAGGCCGACCTGGCCGCTGCAGG
AGTTATGTTACTTTGCCACTTCTTCACGGACCAGTTTCAGTTCGCCGATGGGAAACCCGGAGACCAAATCCTTGA
TTGGCAGTATGGAGTTACTCAGGCCTTCCCTCACACAGAGGAGGAGGTGGAAGTTGATTCACACGCGTACAGCCA
CAGGTGGAAAAGAAACTTGGACTTTCTCAAGGCGGTAGACACGAACCGAGCAAGCGTCGGCCAAGACTCTCCTGA
GCCCAGAAGCTTCACAGACCTGCTGCTGGATGATGGGCAGGACAATAACACTCAGATCGAGGAGGATACAGACCA
CAATTACTATATATCTCGAATATATGGTCCATCTGATTCTGCCAGCCGGGATTTATGGGTGAACATAGACCAAAT
GGAAAAAGATAAAGTGAAGATTCATGGAATATTGTCCAATACTCATCGGCAAGCTGCAAGAGTGAATCTGTCCTT
CGATTTTCCATTTTATGGCCACTTCCTACGTGAAATCACTGTGGCAACCGGGGGTTTCATATACACTGGAGAAGT
CGTACATCGAATGCTAACAGCCACACAGTACATAGCACCTTTAATGGCAAATTTCGATCCCAGTGTATCCAGAAA
TTCAACTGTCAGATATTTTGATAATGGCACAGCACTTGTGGTCCAGTGGGACCATGTACATCTCCAGGATAATTA
TAACCTGGGAAGCTTCACATTCCAGGCAACCCTGCTCATGGATGGACGAATCATCTTTGGATACAAAGAAATTCC
TGTCTTGGTCACACAGATAAGTTCAACCAATCATCCAGTGAAAGTCGGACTGTCCGATGCATTTGTCGTTGTCCA
CAGGATCCAACAAATTCCCAATGTTCGAAGAAGAACAATTTATGAATACCACCGAGTAGAGCTACAAATGTCAAA
AATTACCAACATTTCGGCTGTGGAGATGACCCCATTACCCACATGCCTCCAGTTTAACAGATGTGGCCCCTGTGT
ATCTTCTCAGATTGGCTTCAACTGCAGTTGGTGTAGTAAACTTCAAAGATGTTCCAGTGGATTTGATCGTCATCG
GCAGGACTGGGTGGACAGTGGATGCCCTGAAGAGTCAAAAGAGAAGATGTGTGAGAATACAGAACCAGTGGAAAC
TTCTTCTCGAACCACCACAACCGTAGGAGCGACAACCACCCAGTTCAGGGTCCTAACTACCACCAGAAGAGCAGT
GACTTCTCAGTTTCCCACCAGCCTCCCTACAGAAGATGATACCAAGATAGCACTACATCTAAAAGATAATGGAGC
TTCTACAGATGACAGTGCAGCTGAGAAGAAAGGGGGAACCCTCCACGCTGGCCTCATCATTGGAATCCTCATCCT
GGTCCTCATTGTAGCCACAGCCATTCTTGTGACAGTCTATATGTATCACCACCCAACATCAGCAGCCAGCATCTT
CTTTATTGAGAGACGCCCAAGCAGATGGCCTGCGATGAAGTTTAGAAGAGGCTCTGGACATCCTGCCTATGCTGA
AGTTGAACCAGTTGGAGAGAAAGAAGGCTTTATTGTATCAGAGCAGTGCTAAAATTTCTAGGACAGAACAACACC
AGTACTGGTTTACAGGTGTTAAGACTAAAATTTTGCCTATACCTTTAAGACAAACAAACAAACACACACACAAAC
AAGCTCTAAGCTGCTGTAGCCTGAAGAAGACAAGATTTCTGGACAAGCTCAGCCCAGGAAACAAAGGGTAAACAA
AAAACTAAAACTTATACAAGATACCATTTACACTGAACATAGAATTCCCTAGTGGAATGTCATCTATAGTTCACT
CGGAACATCTCCCGTGGACTTATCTGAAGTATGACAAGATTATAATGCTTTTGGCTTAGGTGCAGGGTTGCAAAG
GGATCAGAAAAAAAAAATCATAATAAAGCTTTAGTTCATGAGGG

FIGURE 472

MARFPKADLAAAGVMLLCHFFTDQFQFADGKPGDQILDWQYGVTQAFPHTEEEVEVDSHAYSH
RWKRNLDFLKAVDTNRASVGQDSPEPRSFTDLLLDDGQDNNTQIEEDTDHNYYISRIYGPSDS
ASRDLWVNIDQMEKDKVKIHGILSNTHRQAARVNLSFDFPFYGHFLREITVATGGFIYTGEVV
HRMLTATQYIAPLMANFDPSVSRNSTVRYFDNGTALVVQWDHVHLQDNYNLGSFTFQATLLMD
GRIIFGYKEIPVLVTQISSTNHPVKVGLSDAFVVVHRIQQIPNVRRRTIYEYHRVELQMSKIT
NISAVEMTPLPTCLQFNRCGPCVSSQIGFNCSWCSKLQRCSSGFDRHRQDWVDSGCPEESKEK
MCENTEPVETSSRTTTTVGATTTQFRVLTTTRRAVTSQFPTSLPTEDDTKIALHLKDNGASTD
DSAAEKKGGTLHAGLIIGILILVLIVATAILVTVYMYHHPTSAASIFFIERRPSRWPAMKFRR
GSGHPAYAEVEPVGEKEGFIVSEQC

Important features of the protein:
Transmembrane domain:
amino acids 454-478

N-glycosylation sites.
amino acids 103-107, 160-164, 213-217, 221-225, 316-320, 345-349 cAMP- and cGMP-dependent protein kinase phosphorylation sites.
amino acids 297-301, 492-496, 503-507

N-myristoylation sites.
amino acids 42-48, 100-106, 147-153, 279-285, 397-403, 450-456, 455-461

FIGURE 473

CGCGGAGCCCTGCGCTGGGAGGTGCACGGTGTGCACGCTGGACTGGACCCCCATGCAACCCCG
CGCCCTGCGCCTTAACCAGGACTGCTCCGCGCGCCCCTGAGCCTCGGGCTCCGGCCCGGACCT
GCAGCCTCCCAGGTGGCTGGGAAGAACTCTCCAACAATAAATACATTTGATAAGAAAGATGGC
TTTAAAAGTGCTACTAGAACAAGAGAAAACGTTTTTCACTCTTTTAGTATTACTAGGCTATTT
GTCATGTAAAGTGACTTGTGAATCAGGAGACTGTAGACAGCAAGAATTCAGGGATCGGTCTGG
AAACTGTGTTCCCTGCAACCAGTGTGGGCCAGGCATGGAGTTGTCTAAGGAATGTGGCTTCGGC
TATGGGGAGGATGCACAGTGTGTGACGTGCCGGCTGCACAGGTTCAAGGAGGACTGGGGCTTC
CAGAAATGCAAGCCCTGTCTGGACTGCGCAGTGGTGAACCGCTTTCAGAAGGCAAATTGTTCA
GCCACCAGTGATGCCATCTGCGGGGACTGCTTGCCAGGATTTTATAGGAAGACGAAACTTGTC
GGCTTTCAAGACATGGAGTGTGTGCCTTGTGGAGACCCTCCTCCTCCTTACGAACCGCACTGT
GCCAGCAAGGTCAACCTCGTGAAGATCGCGTCCACGGCCTCCAGCCCACGGGACACGGCGCTG
GCTGCCGTTATCTGCAGCGCTCTGGCCACCGTCCTGCTGGCCCTGCTCATCCTCTGTGTCATC
TATTGTAAGAGACAGTTTATGGAGAAGAAACCCAGCTGGTCTCTGCGGTCGCAGGACATTCAG
TACAACGGCTCTGAGCTGTCGTGTTTTGACAGACCTCAGCTCCACGAATATGCCCACAGAGCC
TGCTGCCAGTGCCGCCGTGACTCAGTGCAGACCTGCGGGCCGGTGCGCTTGCTCCCATCCATG
TGCTGTGAGGAGGCCTGCAGCCCCAACCCGGCGACTCTTGGTTGTGGGGTGCATTCTGCAGCC
AGTCTTCAGGCAAGAAACGCAGGCCCAGCCGGGGAGATGGTGCCGACTTTCTTCGGATCCCTC
ACGCAGTCCATCTGTGGCGAGTTTTCAGATGCCTGGCCTCTGATGCAGAATCCCATGGGTGGT
GACAACATCTCTTTTTGTGACTCTTATCCTGAACTCACTGGAGAAGACATTCATTCTCTCAAT
CCAGAACTTGAAAGCTCAACGTCTTTGGATTCAAATAGCAGTCAAGATTTGGTTGGTGGGGCT
GTTCCAGTCCAGTCTCATTCTGAAAACTTTACAGCAGCTACTGATTTATCTAGATATAACAAC
ACACTGGTAGAATCAGCATCAACTCAGGATGCACTAACTATGAGAAGCCAGCTAGATCAGGAG
AGTGGCGCTGTCATCCACCCAGCCACTCAGACGTCCCTCCAGGAAGCTTAAAGAACCTGCTTC
TTTCTGCAGTAGAAGCGTGTGCTGGAACCCAAAGAGTACTCCTTTGTTAGGCTTATGGACTGA
GCAGTCTGGACCTTGCATGGCTTCTGGGGCAAAAATAAATCTGAACCAAACTGACGGCATTTG
AAGCCTTTCAGCCAGTTGCTTCTGAGCCAGACCAGCTGTAAGCTGAAACCTCAATGAATAACA
AGAAAAGACTCCAGGCCGACTCATGATACTCTGCATCTTTCCTACATGAGAAGCTTCTCTGCCAC
AAAAGTGACTTCAAAGACTGATGGGTTGAGCTGGCAGCCTATGAGATTGTGGACATATAACAA
GAAACAGAAATGCCCTCATGCTTATTTTCATGGTGATTGTGGTTTTACAAGACTGAAGACCCA
GAGTATACTTTTTCTTTCCAGAAATAATTTCATACCGCCTATGAAATATCAGATAAATTACCT
TAGCTTTTATGTAGAATGGGTTCAAAAGTGAGTGTTTCTATTTGAGAAGGACACTTTTTCATC
ATCTAAACTGATTCGCATAGGTGGTTAGAATGGCCCTCATATTGCCTGCCTAAATCTTGGGTT
TATTAGATGAAGTTTACTGAATCAGAGGAATCAGACAGAGGAGGATAGCTCTTTCCAGAATCC
ACACTTCTGACCTCAGCCTCGGTCTCATGAACACCCGCTGATCTCAGGAGAACACCTGGGCTA
GGGAATGTGGTCGAGAAAGGGCAGCCCATTGCCCAGAATTAACACATATTGTAGAGACTTGTA
TGCAAAGGTTGGCATATTTATATGAAAATTAGTTGCTATAGAAACATTTGTTGCATCTGTCCC
TCTGCCTGAGCTTAGAAGGTTATAGAAAAAGGGTATTTATAAACATAAATGACCTTTTACTTG
CATTGTATCTTATACTAAAGGCTTTAGAAATTACAACATATCAGGTTCCCCTACTACTGAAGT
AGCCTTCCGTGAGAACACACCACATGTTAGGACTAGAAGAAAATGCACAATTTGTAGGGGTTT
GGATGAAGCAGCTGTAACTGCCCTAGTGTAGTTTGACCAGGACATTGTCGTGCTCCTTCCAAT
TGTGTAAGATTAGTTAGCACATCATCTCCTACTTTAGCCATCCGGTGTTGGATTTAAGAGGAC
GGTGCTTCTTTCTATTAAAGTGCTCCATCCCCTACCATCTACACATTAGCATTGTCTCTAGAG
CTAAGACAGAAATTAACCCCGTTCAGTCACAAAGCAGGGAATGGTTCATTTACTCTTAATCTT
TATGCCCTGGAGAAGACCTACTTGAACAGGGCATATTTTTTAGACTTCTGAACATCAGTATGT
TCGAGGGTACTATGATATTTTGGTTTGGAATTGCCCTGCCCAAGTCACTGTCTTTTAACTTTT
AAACTGAATATTAAAATGTATCTGTCTTTCCT

FIGURE 474

></usr/seqdb2/sst/DNA/Dnaseqs.min/ss.DNA84210
><subunit 1 of 1, 417 aa, 1 stop
><MW: 45305, pI: 5.12, NX(S/T): 6
MALKVLLEQEKTFFTLLVLLGYLSCKVTCESGDCRQQEFRDRSGNCVPCNQCGPGMELSK
ECGFGYGEDAQCVTCRLHRFKEDWGFQKCKPCLDCAVVNRFQKANCSATSDAICGDCLPG
FYRKTKLVGFQDMECVPCGDPPPPYEPHCASKVNLVKIASTASSPRDTALAAVICSALAT
VLLALLILCVIYCKRQFMEKKPSWSLRSQDIQYNGSELSCFDRPQLHEYAHRACCQCRRD
SVQTCGPVRLLPSMCCEEACSPNPATLGCGVHSAASLQARNAGPAGEMVPTFFGSLTQSI
CGEFSDAWPLMQNPMGGDNISFCDSYPELTGEDIHSLNPELESSTSLDSNSSQDLVGGAV
PVQSHSENFTAATDLSRYNNTLVESASTQDALTMRSQLDQESGAVIHPATQTSLQEA

Important features of the protein:
Signal peptide:
Amino acids 1-25

Transmembrane domain:
Amino acids 169-192

N-glycosylation sites:
Amino acids 105-109;214-218;319-323;350-354;368-372;379-383 cAMP- and cGMP-dependent protein kinase phosphorylation sites:
Amino acids 200-204;238-242

Tyrosine kinase phosphorylation site:
Amino acids 207-214

N-myristoylation sites:
Amino acids 55-61;215-221;270-276

Prokaryotic membrane lipoprotein lipid attachment site:
Amino acids 259-270

TNFR/NGFR family cysteine-rich region proteins:
Amino acids 89-96

FIGURE 475

AGCCAGGCAGCACATCACAGCGGGAGGAGCTGTCCCAGGTGGCCCAGCTCAGCAATGGCAATG
GGGGTCCCCAGAGTCATTCTGCTCTGCCTCTTTGGGGCTGCGCTCTGCCTGACAGGGTCCCAA
GCCCTGCAGTGCTACAGCTTTGAGCACACCTACTTTGGCCCCTTTGACCTCAGGGCCATGAAG
CTGCCCAGCATCTCCTGTCCTCATGAGTGCTTTGAGGCTATCCTGTCTCTGGACACCGGGTAT
CGCGCGCCGGTGACCCTGGTGCGGAAGGGCTGCTGGACCGGGCCTCCTGCGGGCCAGACGCAA
TCGAACCCGGACGCGCTGCCGCCAGACTACTCGGTGGTGCGCGGCTGCACAACTGACAAATGC
AACGCCCACCTCATGACTCATGACGCCCTCCCCAACCTGAGCCAAGCACCCGACCCGCCGACG
CTCAGCGGCGCCGAGTGCTACGCCTGTATCGGGGTCCACCAGGATGACTGCGCTATCGGCAGG
TCCCGACGAGTCCAGTGTCACCAGGACCAGACCGCCTGCTTCCAGGGCAGTGGCAGAATGACA
GTTGGCAATTTCTCAGTCCCTGTGTACATCAGAACCTGCCACCGGCCCTCCTGCACCACCGAG
GGCACCACCAGCCCCTGGACAGCCATCGACCTCCAGGGCTCCTGCTGTGAGGGGTACCTCTGC
AACAGGAAATCCATGACCCAGCCCTTCACCAGTGCTTCAGCCACCACCCCTCCCCGAGCACTA
CAGGTCCTGGCCCTGCTCCTCCCAGTCCTCCTGCTGGTGGGGCTCTCAGCATAGACCGCCCCT
CCAGGATGCTGGGGACAGGGCTCACACACCTCATTCTTGCTGCTTCAGCCCCTATCACATAGC
TCACTGGAAAATGATGTTAAAGTAAGAATTGCAAAA

FIGURE 476

></usr/seqdb2/sst/DNA/Dnaseqs.min/ss.DNA86576
><subunit 1 of 1, 251 aa, 1 stop
><MW: 26935, pI: 7.42, NX(S/T): 2
MAMGVPRVILLCLFGAALCLTGSQALQCYSFEHTYFGPFDLRAMKLPSISCPHECFEAILSLD
TGYRAPVTLVRKGCWTGPPAGQTQSNPDALPPDYSVVRGCTTDKCNAHLMTHDALPNLSQAPD
PPTLSGAECYACIGVHQDDCAIGRSRRVQCHQDQTACFQGSGRMTVGNFSVPVYIRTCHRPSC
TTEGTTSPWTAIDLQGSCCEGYLCNRKSMTQPFTSASATTPPRALQVLALLLPVLLLVGLSA

Important features of the protein:
Signal peptide:
amino acids 1-19

Transmembrane domain:
amino acids 233-251

N-glycosylation sites.
amino acids 120-124, 174-178

N-myristoylation sites.
amino acids 15-21, 84-90

FIGURE 477

CCCACGCGTCCGGGACAGATGAACTTAAAAGAGAAGCTTTAGCTGCCAAAGATTGGGAAAGGGAAAGGACAAAAA
AGACCCCTGGGCTACACGGCGTAGGTGCAGGGTTTCCTACTGCTGTTCTTTTATGCTGGGAGCTGTGGCTGTAAC
CAACTAGGAAATAACGTATGCAGCAGCTATGGCTGTCAGAGAGTTGTGCTTCCCAAGACAAAGGCAAGTCCTGTT
TCTTTTTCTTTTTTGGGGAGTGTCCTTGGCAGGTTCTGGGTTTGGACGTTATTCGGTGACTGAGGAAACAGAGAA
AGGATCCTTTGTGGTCAATCTGGCAAAGGATCTGGGACTAGCAGAGGGGGAGCTGGCTGCAAGGGGAACCAGGGT
GGTTTCCGATGATAACAAACAATACCTGCTCCTGGATTCACATACCGGGAATTTGCTCACAAATGAGAAACTGGA
CCGAGAGAAGCTGTGTGGCCCTAAAGAGCCCTGTATGCTGTATTTCCAAATTTTAATGGATGATCCCTTTCAGAT
TTACCGGGCTGAGCTGAGAGTCAGGGATATAAATGATCACGCGCCAGTATTTCAGGACAAAGAAACAGTCTTAAA
AATATCAGAAAATACAGCTGAAGGGACAGCATTTAGACTAGAAAGAGCACAGGATCCAGATGGAGGACTTAACGG
TATCCAAAACTACACGATCAGCCCCAACTCTTTTTTCCATATTAACATTAGTGGCGGTGATGAAGGCATGATATA
TCCAGAGCTAGTGTTGGACAAAGCACTGGATCGGGAGGAGCAGGGAGAGCTCAGCTTAACCCTCACAGCGCTGGA
TGGTGGGTCTCCATCCAGGTCTGGGACCTCTACTGTACGCATCGTTGTCTTGGACGTCAATGACAATGCCCCACA
GTTTGCCCAGGCTCTGTATGAGACCCAGGCTCCAGAAAACAGCCCCATTGGGTTCCTTATTGTTAAGGTATGGGC
AGAAGATGTAGACTCTGGAGTCAACGCGGAAGTATCCTATTCATTTTTTGATGCCTCAGAAAATATTCGAACGAC
CTTTCAAATCAATCCTTTTTCTGGGGAAATCTTTCTCAGAGAATTGCTTGATTATGAGTTAGTAAATTCTTACAA
AATAAATATACAGGCAATGGACGGTGGAGGCCTTTCTGCAAGATGTAGGGTTTTAGTGGAAGTATTGGACACCAA
TGACAATCCCCCCTGAACTGATCGTATCATCATTTTCCAACTCTGTTGCTGAGAATTCTCCTGAGACGCCGCTGGC
TGTTTTTAAGATTAATGACAGAGACTCTGGAGAAAATGGAAAGATGGTTTGCTACATTCAAGAGAATCTGCCATT
CCTACTAAAACCTTCTGTGGAGAATTTTTACATCCTAATTACAGAAGGCGCGCTGGACAGAGAGATCAGAGCCGA
GTACAACATCACTATCACCGTCACTGACTTGGGGACACCCAGGCTGAAAACCGAGCACAACATAACGGTCCTGGT
CTCCGACGTCAATGACAACGCCCCCGCCTTCACCCAAACCTCCTACACCCTGTTCGTCCGCGAGAACAACAGCCC
CGCCCTGCACATCGGCAGCGTCAGCGCCACAGACAGAGACTCGGGCACCAACGCCCAGGTCACCTACTCGCTGCT
GCCGCCCCAAGACCCGCACCTGCCCCTCGCCTCCCTGGTCTCCATCAACGCGGACAACGGCCACCTGTTCGCCCT
CAGGTCGCTGGACTACGAGGCCCTGCAGGCTTTCGAGTTCCGCGTGGGCGCCACAGACCGCGGCTCCCCCGCGCT
GAGCAGAGAGGCGCTGGTGCGCGTGCTGGTGCTGGACGCCAACGACAACTCGCCCTTCGTGCTGTACCCGCTGCA
GAACGGCTCCGCGCCCTGCACCGAGCTGGTGCCCCGGGCGGCCGAGCCGGGCTACCTGGTGACCAAGGTGGTGGC
GGTGGACGGCGACTCGGGCCAGAACGCCTGGCTGTCGTACCAGCTGCTCAAGGCCACGGAGCCCGGGCTGTTCGG
TGTGTGGGCGCACAATGGGGAGGTGCGCACCGCCAGGCTGCTGAGCGAGCGCGACGCAGCCAAGCACAGGCTCGT
GGTGCTTGTCAAGGACAATGGCGAGCCTCCTCGCTCGGCCACCGCCACGCTGCACTTGCTCCTGGTGGACGGCTT
CTCCCAGCCCTACCTGCCTCTCCCGGAGGCGGCCCCGGCCCAGGCCCAGGCCGAGGCCGACTTGCTCACCGTCTA
CCTGGTGGTGGCGTTGGCCTCGGTGTCTTCGCTCTTCCTCCTCTCGGTGCTCCTGTTCGTGGCGGTGCGGCTGTG
CAGGAGGAGCAGGGCGGCCTCGGTGGGTCGCTGCTCGGTGCCCGAGGGTCCTTTTCCAGGGCATCTGGTGGACGT
GAGGGGCGCTGAGACCCTGTCCCAGAGCTACCAGTATGAGGTGTGTCTGACGGGAGGCCCCGGGACCAGTGAGTT
CAAGTTCTTGAAACCAGTTATTTCGGATATTCAGGCACAGGGCCCTGGGAGGAAGGGTGAAGAAAATTCCACCTT
CCGAAATAGCTTTGGATTTAATATTCAGTAAAGTCTGTTTTTAGTTTCATATACTTTTGGTGTGTTACATAGCCA
TGTTTCTATTAGTTTACTTTTAAATCTCAAATTTAAGTTATTATGCAACTTCAAGCATTATTTTCAAGTAGTATA
CCCCTGTGGTTTTACAATGTTTCATCATTTTTTTGCATTAATAACAACTGGGTTTAATTTAATGAGTATTTTTTT
CTAAATGATAGTGTTAAGGTTTTAATTCTTTCCAACTGCCCAAGGAATTAATTACTATTATATCTCATTACAGAA
ATCTGAGGTTTTGATTCATTTCAGAGCTTGCATCTCATGATTCTAATCACTTCTGTCTATAGTGTACTTGCTCTA
TTTAAGAAGGCATATCTACATTTCCAAACTCATTCTAACATTCTATATATTCGTGTTTGAAAACCATGTCATTTA
TTTCTACATCATGTATTTAAAAAGAAATATTTCTCTACTACTATGCTCATGACAAAATGAAACAAAGCATATTGT
GAGCAATACTGAACATCAATAATACCCTTAGTTTATATACTTATTATTTTATCTTTAAGCATGCTACTTTTACTT
GGCCAATATTTTCTTATGTTAACTTTTGCTGATGTATAAAACAGACTATGCCTTATAATTGAAATAAAATTATAA
TCTGCCTGAAAATGAATAAAAATAAAACATTTTGAAATGTGAAAAAAAAAAAAAAAAAAAAA

FIGURE 478

></usr/seqdb2/sst/DNA/Dnaseqs.min/ss.DNA87976
><subunit 1 of 1, 800 aa, 1 stop
><MW: 87621, pI: 4.77, NX(S/T): 7
MAVRELCFPRQRQVLFLFLFWGVSLAGSGFGRYSVTEETEKGSFVVNLAKDLGLAEGELAARG
TRVVSDDNKQYLLLDSHTGNLLTNEKLDREKLCGPKEPCMLYFQILMDDPFQIYRAELRVRDI
NDHAPVFQDKETVLKISENTAEGTAFRLERAQDPDGGLNGIQNYTISPNSFFHINISGGDEGM
IYPELVLDKALDREEQGELSLTLTALDGGSPSRSGTSTVRIVVLDVNDNAPQFAQALYETQAP
ENSPIGFLIVKVWAEDVDSGVNAEVSYSFFDASENIRTTFQINPFSGEIFLRELLDYELVNSY
KINIQAMDGGGLSARCRVLVEVLDTNDNPPELIVSSFSNSVAENSPETPLAVFKINDRDSGEN
GKMVCYIQENLPFLLKPSVENFYILITEGALDREIRAEYNITITVTDLGTPRLKTEHNITVLV
SDVNDNAPAFTQTSYTLFVRENNSPALHIGSVSATDRDSGTNAQVTYSLLPPQDPHLPLASLV
SINADNGHLFALRSLDYEALQAFEFRVGATDRGSPALSREALVRVLVLDANDNSPFVLYPLQN
GSAPCTELVPRAAEPGYLVTKVVAVDGDSGQNAWLSYQLLKATEPGLFGVWAHNGEVRTARLL
SERDAAKHRLVVLVKDNGEPPRSATATLHLLLVDGFSQPYLPLPEAAPAQAQAEADLLTVYLV
VALASVSSLFLLSVLLFVAVRLCRRSRAASVGRCSVPEGPFPGHLVDVRGAETLSQSYQYEVC
LTGGPGTSEFKFLKPVISDIQAQGPGRKGEENSTFRNSFGFNIQ

Important features of the protein:
Signal peptide:
amino acids 1-26
Transmembrane domain:
amino acids 687-711
N-glycosylation sites.
amino acids 169-173, 181-185, 418-422, 436-440, 567-571, 788-792
Glycosaminoglycan attachment site.
amino acids 28-32
Tyrosine kinase phosphorylation sites.
amino acids 394-402, 578-585
N-myristoylation sites.
amino acids 22-28, 27-33, 53-59, 82-88, 162-168, 184-190, 217-223, 324-330, 325-331, 471-477, 568-574, 759-765
Amidation site.
amino acids 781-785
Aminoacyl-transfer RNA synthetases class-II signature 1.
amino acids 117-138
Cadherins extracellular repeated domain signature.
amino acids 121-132, 230-241, 335-346, 439-450, 549-560

FIGURE 479

CTCGGCTGGATTTAAGGTTGCCGCTAGCCGCCTGGGAATTTAAGGGACCCACACTACCTTCCC
GAAGTTGAAGGCAAGCGGTGATTGTTTGTAGACGGCGCTTTGTCATGGGACCTGTGCGGTTGG
GAATATTGCTTTTCCTTTTTTTGGCCGTGCACGAGGCTTGGGCTGGGATGTTGAAGGAGGAGG
ACGATGACACAGAACGCTTGCCCAGCAAATGCGAAGTGTGTAAGCTGCTGAGCACAGAGCTAC
AGGCGGAACTGAGTCGCACCGGTCGATCTCGAGAGGTGCTGGAGCTGGGGCAGGTGCTGGATA
CAGGCAAGAGGAAGAGACACGTGCCTTACAGCGTTTCAGAGACAAGGCTGGAAGAGGCCTTAG
AGAATTTATGTGAGCGGATCCTGGACTATAGTGTTCACGCTGAGCGCAAGGGCTCACTGAGAT
ATGCCAAGGGTCAGAGTCAGACCATGGCAACACTGAAAGGCCTAGTGCAGAAGGGGGTGAAGG
TGGATCTGGGGATCCCTCTGGAGCTTTGGGATGAGCCCAGCGTGGAGGTCACATACCTCAAGA
AGCAGTGTGAGACCATGTTGGAGGAGTTTGAAGACATTGTGGGAGACTGGTACTTCCACCATC
AGGAGCAGCCCCTACAAAATTTTCTCTGTGAAGGTCATGTGCTCCCAGCTGCTGAAACTGCAT
GTCTACAGGAAACTTGGACTGGAAAGGAGATCACAGATGGGGAAGAGAAAACAGAAGGGGAGG
AAGAGCAGGAGGAGGAGGAGGAAGAGGAGGAAGAGGAAGGGGGAGACAAGATGACCAAGACAG
GAAGCCACCCCAAACTTGACCGAGAAGATCTTTGACCCTTGCCTTTGAGCCCCCAGGAGGGGA
AGGGATCATGGAGAGCCCTCTAAAGCCTGCACTCTCCCTGCTCCACAGCTTTCAGGGTGTGTT
TATGAGTGACTCCACCCAAGCTTGTAGCTGTTCTCTCCCATCTAACCTCAGGCAAGATCCTGG
TGAAACAGCATGACATGGCTTCTGGGGTGGAGGGTGGGGGTGGAGGTCCTGCTCCTAGAGATG
AACTCTATCCAGCCCCTTAATTGGCAGGTGTATGTGCTGACAGTACTGAAAGCTTTCCTCTTT
AACTGATCCCACCCCCACCCAAAAGTCAGCAGTGGCACTGGAGCTGTGGGCTTTGGGGAAGTC
ACTTAGCTCCTTAAGGTCTGTTTTTAGACCCTTCCAAGGAAGAGGCCAGAACGGACATTCTCT
GCGATCTATATACATTGCCTGTATCCAGGAGGCTACACACCAGCAAACCGTGAAGGAGAATGG
GACACTGGGTCATGGCCTGGAGTTGCTGATAATTTAGGTGGATAGATACTTGGTCTACTTAA
GCTCAATGTAACCCAGAGCCCACCATATAGTTTTATAGGTGCTCAACTTTCTATATCGCTATT
AAACTTTTTTCTTTTTTTCTA

FIGURE 480

></usr/seqdb2/sst/DNA/Dnaseqs.min/ss.DNA92256
><subunit 1 of 1, 248 aa, 1 stop
><MW: 28310, pI: 4.63, NX(S/T): 0
MGPVRLGILLFLFLAVHEAWAGMLKEEDDDTERLPSKCEVCKLLSTELQAELSRTGRSREVLE
LGQVLDTGKRKRHVPYSVSETRLEEALENLCERILDYSVHAERKGSLRYAKGQSQTMATLKGL
VQKGVKVDLGIPLELWDEPSVEVTYLKKQCETMLEEFEDIVGDWYFHHQEQPLQNFLCEGHVL
PAAETACLQETWTGKEITDGEEKTEGEEEQEEEEEEEEEEGGDKMTKTGSHPKLDREDL

Important features of the protein:
Signal peptide:
amino acids 1-21 cAMP- and cGMP-dependent protein kinase phosphorylation site.
amino acids 106-110

N-myristoylation site.
amino acids 115-121

Amidation site.
amino acids 70-74

FIGURE 481

GGCGTGTGCAAGGCGGGGTCCGGCCCGCGCAGGTCGGGTAAGCGCGTCTAGGGCGCTGCGCGG
CGCAGCGAAAATGGCGGCTTCCAGGTGGGCGCGCAAGGCCGTGGTCCTGCTTTGTGCCTCTGA
CCTGCTGCTGCTGCTGCTACTGCTACCACCGCCTGGGTCCTGCGCGGCCGAAGGCTCGCCCGG
GACGCCCGACGAGTCTACCCCACCTCCCCGGAAGAAGAAGAAGGATATTCGCGATTACAATGA
TGCAGACATGGCGCGTCTTCTGGAGCAATGGGAGAAAGATGATGACATTGAAGAAGGAGATCT
TCCAGAGCACAAGAGACCTTCAGCACCTGTCGACTTCTCAAAGATAGACCCAAGCAAGCCTGA
AAGCATATTGAAAATGACGAAAAAAGGGAAGACTCTCATGATGTTTGTCACTGTATCAGGAAG
CCCTACTGAGAAGGAGACAGAGGAAATTACGAGCCTCTGGCAGGGCAGCCTTTTCAATGCCAA
CTATGACGTCCAGAGGTTCATTGTGGGATCAGACCGTGCTATCTTCATGCTTCGCGATGGGAG
CTACGCCTGGGAGATCAAGGACTTTTTGGTCGGTCAAGACAGGTGTGCTGATGTAACTCTGGA
GGGCCAGGTGTACCCCGGCAAAGGAGGAGGAAGCAAAGAGAAAAATAAAACAAAGCAAGACAA
GGGCAAAAAAAAGAAGGAAGGAGATCTGAAATCTCGGTCTTCCAAGGAAGAAAATCGAGCTGG
GAATAAAAGAGAAGACCTGTGATGGGGCAGCAGTGACGCGCTGTGGGGGGACAGGTGGACGTG
GAGAGCTCTTTGCCCAGCTCCTGGGGTGGGAGTGGTCTCAGGCAACTGCACACCGGATGACAT
TCTAGTGTCTTCTAGAAAGGGTCTGCCACATGACCAGTTTGTGGTCAAAGAATTACTGCTTAA
TAGGCTTCAAGTAAGAAGACAGATGTTTTCTAATTAATACTGGACACTGACAAATTCATGTTT
ACTATAAAATCTCCTTACATGGAAATGTGACTGTGTTGCTTTTTCCCATTTACACTTGGTGAG
TCATCAACTCTACTGAGATTCCACTCCCCTCCAAGCACCTGCTGTGATTGGGTGGCCTGCTCT
GATCAGATAGCAAATTCTGATCAGAGAAGACTTTAAAACTCTTGACTTAATTGAGTAAACTCT
TCATGCCATATACATCATTTTCATTATGTTAAAGGTAAAATATGCTTTGTGAACTCAGATGTC
TGTAGCCAGGAAGCCAGGGTGTGTAAATCCAAAATCTATGCAGGAAATGCGGAGAATAGAAAA
TATGTCACTTGAAATCCTAAGTAGTTTTGAATTTCTTTGACTTGAATCTTACTCATCAGTAAG
AGAACTCTTGGTGTCTGTCAGGTTTTATGTGGTCTGTAAAGTTAGGGGTTCTGTTTTGTTTCC
TTATTTAGGAAAGAGTACTGCTGGTGTCGAGGGGTTATATGTTCCATTTAATGTGACAGTTTT
AAAGGATTTAAGTAGGGAATCAGAGTCCTTTGCAGAGTGTGACAGACGACTCAATAACCTCAT
TTGTTTCTAAACATTTTTCTTTGATAAAGTGCCTAAATCTGTGCTTTCGTATAGAGTAACATG
ATGTGCTACTGTTGATGTCTGATTTTGCCGTTCATGTTAGAGCCTACTGTGAATAAGAGTTAG
AACATTTATATACAGATGTCATTTCTAAGAACTAAAATTCTTTGGGAAAAACCCTCAAAAAAA
AAAAAAAAAAAAAAAAAAAAA

FIGURE 482

></usr/seqdb2/sst/DNA/Dnaseqs.min/ss.DNA92289
><subunit 1 of 1, 234 aa, 1 stop
><MW: 26077, pI: 8.13, NX(S/T): 1
MAASRWARKAVVLLCASDLLLLLLLLPPPGSCAAEGSPGTPDESTPPPRKKKKDIRDYND
ADMARLLEQWEKDDDIEEGDLPEHKRPSAPVDFSKIDPSKPESILKMTKKGKTLMMFVTV
SGSPTEKETEEITSLWQGSLFNANYDVQRFIVGSDRAIFMLRDGSYAWEIKDFLVGQDRC
ADVTLEGQVYPGKGGGSKEKNKTKQDKGKKKKEGDLKSRSSKEENRAGNKREDL

Important features of the protein:
Signal peptide:
Amino acids 1-32

N-glycosylation site:
Amino acids 201-205 cAMP- and cGMP-dependent protein kinase phosphorylation site:
Amino acids 85-89

Tyrosine kinase phosphorylation site:
Amino acids 50-59

N-myristoylation sites:
Amino acids 30-36;138-144;153-159;176-182

Amidation site:
Amino acids 207-211

FIGURE 483

GTTGCTCCGGCGGCGCTCGGGGAGGGAGCCAGCAGCCTAGGGCCTAGGCCCGGGCCACCATGG
CGCTGCCTCCAGGCCCAGCCGCCCTCCGGCACACACTGCTGCTCCTGCCAGCCCTTCTGAGCT
CAGGTTGGGGGGAGTTGGAGCCACAAATAGATGGTCAGACCTGGGCTGAGCGGGCACTTCGGG
AGAATGAACGCCACGCCTTCACCTGCCGGGTGGCAGGGGGGCCTGGCACCCCCAGATTGGCCT
GGTATCTGGATGGACAGCTGCAGGAGGCCAGCACCTCAAGACTGCTGAGCGTGGGAGGGGAGG
CCTTCTCTGGAGGCACCAGCACCTTCACTGTCACTGCCCATCGGGCCCAGCATGAGCTCAACT
GCTCTCTGCAGGACCCCAGAAGTGGCCGATCAGCCAACGCCTCTGTCATCCTTAATGTGCAAT
TCAAGCCAGAGATTGCCCAAGTCGGCGCCAAGTACCAGGAAGCTCAGGGCCCAGGCCTCCTGG
TTGTCCTGTTTGCCCTGGTGCGTGCCAACCCGCCGGCCAATGTCACCTGGATCGACCAGGATG
GGCCAGTGACTGTCAACACCTCTGACTTCCTGGTGCTGGATGCGCAGAACTACCCCTGGCTCA
CCAACCACACGGTGCAGCTGCAGCTCCGCAGCCTGGCACACAACCTCTCGGTGGTGGCCACCA
ATGACGTGGGTGTCACCAGTGCGTCGCTTCCAGCCCCAGGCCCCTCCCGGCACCCATCTCTGA
TATCAAGTGACTCCAACAACCTAAAACTCAACAACGTGCGCCTGCCACGGGAGAACATGTCCC
TCCCGTCCAACCTTCAGCTCAATGACCTCACTCCAGATTCCAGAGCAGTGAAACCAGCAGACC
GGCAGATGGCTCAGAACAACAGCCGGCCAGAGCTTCTGGACCCGGAGCCCGGCGGCCTCCTCA
CCAGCCAAGGTTTCATCCGCCTCCCAGTGCTGGGCTATATCTATCGAGTGTCCAGCGTGAGCA
GTGATGAGATCTGGCTCTGAGCCGAGGGCGAGACAGGAGTATTCTCTTGGCCTCTGGACACCC
TCCCATTCCTCCAAGGCATCCTCTACCTAGCTAGGTCACCAACGTGAAGAAGTTATGCCACTG
CCACTTTTGCTTGCCCTCCTGGCTGGGGTGCCCTCCATGTCATGCACGTGATGCATTTCACTG
GGCTGTAACCCGCAGGGGCACAGGTATCTTTGGCAAGGCTACCAGTTGGACGTAAGCCCCTCA
TGCTGACTCAGGGTGGGCCCTGCATGTGATGACTGGGCCCTTCCAGAGGGAGCTCTTTGGCCA
GGGGTGTTCAGATGTCATCCAGCATCCAAGTGTGGCATGGCCTGCTGTATACCCCACCCCAGT
ACTCCACAGCACCTTGTACAGTAGGCATGGGGGCGTGCCTGTGTGGGGGACAGGGAGGGCCCT
GCATGGATTTTCCTCCTTCCTATGCTATGTAGCCTTGTTCCCTCAGGTAAAATTTAGGACCCT
GCTAGCTGTGCAGAACCCAATTGCCCTTTGCACAGAAACCAACCCCTGACCCAGCGGTACCGG
CCAAGCACAAACGTCCTTTTTGCTGCACACGTCTCTGCCCTTCACTTCTTCTCTTCTGTCCCC
ACCTCCTCTTGGGAATTCTAGGTTACACGTTGGACCTTCTCTACTACTTCACTGGGCACTAGA
CTTTTCTATTGGCCTGTGCCATCGCCCAGTATTAGCACAAGTTAGGGAGGAAGAGGCAGGCGA
TGAGTCTAGTAGCACCCAGGACGGCTTGTAGCTATGCATCATTTTCCTACGGCGTTAGCACTT
TAAGCACATCCCCTAGGGGAGGGGGTGAGTGAGGGGCCCAGAGCCCTCTTTGTGGCTTCCCCA
CGTTTGGCCTTCTGGGATTCACTGTGAGTGTCCTGAGCTCTCGGGGTTGATGGTTTTTCTCTC
AGCATGTCTCCTCCACCACGGGACCCCAGCCCTGACCAACCCATGGTTGCCTCATCAGCAGGA
AGGTGCCCTTCCTGGAGGATGGTCGCCACAGGCACATAATTCAACAGTGTGGAAGCTTTAGGG
GAACATGGAGAAAGAAGGAGACCACATACCCCAAAGTGACCTAAGAACACTTTAAAAAGCAAC
ATGTAAATGATTGGAAATTAATATAGTACAGAATATATTTTTCCCTTGTTGAGATCTTCTTTT
GTAATGTTTTTCATGTTACTGCCTAGGGCGGTGCTGAGCACACAGCAAGTTTAATAAACTTGA
CTGAATTCATTTAAAAAAAAAAAAAAAAAAAAAAAAAAAAAAAAAAAAAAAAAAAAAAAAAAA
AAAAAAAAAAAAAAAAAAAAAAAAAAAAAAAAAAAAAAAAAAAAAAAAA

FIGURE 484

MALPPGPAALRHTLLLLPALLSSGWGELEPQIDGQTWAERALRENERHAFTCRVAGGPGTPRL
AWYLDGQLQEASTSRLLSVGGEAFSGGTSTFTVTAHRAQHELNCSLQDPRSGRSANASVILNV
QFKPEIAQVGAKYQEAQGPGLLVVLFALVRANPPANVTWIDQDGPVTVNTSDFLVLDAQNYPW
LTNHTVQLQLRSLAHNLSVVATNDVGVTSASLPAPGPSRHPSLISSDSNNLKLNNVRLPRENM
SLPSNLQLNDLTPDSRAVKPADRQMAQNNSRPELLDPEPGGLLTSQGFIRLPVLGYIYRVSSV
SSDEIWL

N-glycosylation sites:
amino acids 106-110, 119-123, 162-166, 175-179, 192-196, 205-209, 251-255, 280-284

Glycosaminoglycan attachment site:
amino acids 23-27

Casein kinase II phosphorylation sites:
amino acids 36-40, 108-112, 164-168, 282-286, 316-320

N-myristoylation sites:
amino acids 34-40, 89-95, 215-221, 292-298, 293-299

FIGURE 485

AGAGTTCCTTTTTCTAGGTCGATTAGGTTATACATTGTTGAAGTATAGTTTCGAGTTAGAATT
GGTCATTTTATTTTCAGTGTTTCACAGAAATCGAAGAAGACAGAAATGGCGCTTCTGTGGTGG
ATATCTACAGTAGCAATACTGTTGTTTACTTCGACGATTTTGGGAACATACGTTGAAGCTGGT
GCCGCTAAGTCTAACGAAGAAGAGATTGTGAACAAAAGCGAATTTGGAAGATTTCCACGAGGG
TCGAGAAAGGATGCATCGGGGTGCCACAAGCCGGGCTACCCTGTACCCCCTCATTCTCGCTGC
CCTCCACCTCCCCATGTGCAGCGTCCTCGTCCTATTCTGCATGCTTAGTCTAACACCATCAGG
CTCGTTTATCTTTTCTGTCATTGATCTCACCAGGAGCAAATCACTAGTGCGTGCTTCTGATTC
ACGTAACGTAGTATGTAAATAAATGTCAGTGATATTATGAATTGGTAAAACATTTCTGTTATC
TAAATAAAACAGTGAAGTTTGTTTGACTAAAAAAA

FIGURE 486

></usr/seqdb2/sst/DNA/Dnaseqs.min/ss.DNA96855
><subunit 1 of 1, 84 aa, 1 stop
><MW: 9274, pI: 9.70, NX(S/T): 1
MALLWWISTVAILLFTSTILGTYVEAGAAKSNEEEIVNKSEFGRFPRGSRKDASGCHKPG
YPVPPHSRCPPPPHVQRPRPILHA

Signal peptide:
Amino acids 1-21

N-glycosylation site:
Amino acids 38-42

N-myristoylation site:
Amino acids 27-33

FIGURE 487

CGGGGACGGAAGCGGCCCCTGGGCCCGAGGGGCTGGAGCCGGGCCGGGGCGATGTGGAGCGCG
GGCCGCGGCGGGGCTGCCTGGCCGGTGCTGTTGGGGCTGCTGCTGGCGCTGTTAGTGCCGGGC
GGTGGTGCCGCCAAGACCGGTGCGGAGCTCGTGACCTGCGGGTCGGTGCTGAAGCTGCTCAAT
ACGCACCACCGCGTGCGGCTGCACTCGCACGACATCAAATACGGATCCGGCAGCGGCCAGCAA
TCGGTGACCGGCGTAGAGGCGTCGGACGACGCCAATAGCTACTGGCGGATCCGCGGCGGCTCG
GAGGGCGGGTGCCCGCGCGGGTCCCCGGTGCGCTGCGGGCAGGCGGTGAGGCTCACGCATGTG
CTTACGGGCAAGAACCTGCACACGCACCACTTCCCGTCGCCGCTGTCCAACAACCAGGAGGTG
AGTGCCTTTGGGGAAGACGGCGAGGGCGACGACCTGGACCTATGGACAGTGCGCTGCTCTGGA
CAGCACTGGGAGCGTGAGGCTGCTGTGCGCTTCCAGCATGTGGGCACCTCTGTGTTCCTGTCA
GTCACGGGTGAGCAGTATGGAAGCCCCATCCGTGGGCAGCATGAGGTCCACGGCATGCCCAGT
GCCAACACGCACAATACGTGGAAGGCCATGGAAGGCATCTTCATCAAGCCTAGTGTGGAGCCC
TCTGCAGGTCACGATGAACTCTGAGTGTGTGGATGGATGGGTGGATGGAGGGTGGCAGGTGGG
GCGTCTGCAGGGCCACTCTTGGCAGAGACTTTGGGTTTGTAGGGGTCCTCAAGTGCCTTTGTG
ATTAAAGAATGTTGGTCTATGAAA

FIGURE 488

></usr/seqdb2/sst/DNA/Dnaseqs.min/ss.DNA96857
><subunit 1 of 1, 221 aa, 1 stop
><MW: 23598, pI: 6.96, NX(S/T): 0
MWSAGRGGAAWPVLLGLLLALLVPGGGAAKTGAELVTCGSVLKLLNTHHRVRLHSHDIKYGSG
SGQQSVTGVEASDDANSYWRIRGGSEGGCPRGSPVRCGQAVRLTHVLTGKNLHTHHFPSPLSN
NQEVSAFGEDGEGDDLDLWTVRCSGQHWEREAAVRFQHVGTSVFLSVTGEQYGSPIRGQHEVH
GMPSANTHNTWKAMEGIFIKPSVEPSAGHDEL

Important features of the protein:
Signal peptide:
amino acids 1-28

Glycosaminoglycan attachment site.
amino acids 62-66

N-myristoylation sites.
amino acids 16-22, 25-31, 27-33, 61-67, 71-77, 86-92, 87-93, 91-97, 190-196

Endoplasmic reticulum targeting sequence.
amino acids 218-223

FIGURE 489

CAGCAGCCGAGACAGCAGCTGAGACGGCAGCGGCAGCTTCTCAGGGCCGGAGCCAGTTCTTGGAGGAGACTCTGC
ACAGGGCATGGATCACTGTGGTGCCCTTTTCCTGTGCCTGTGCCTTCTGACTTTGCAGAATGCAACAACAGAGAC
ATGGGAAGAACTCCTGAGCTACATGGAGAATATGCAGGTGTCCAGGGGCCGGAGCTCAGTTTTTTCCTCTCGTCA
ACTCCACCAGCTGGAGCAGATGCTACTGAACACCAGCTTCCCAGGCTACAACCTGACCTTGCAGACACCCACCAT
CCAGTCTCTGGCCTTCAAGCTGAGCTGTGACTTCTCTGGCCTCTCGCTGACCAGTGCCACTCTGAAGCGGGTGCC
CCAGGCAGGAGGTCAGCATGCCCGGGGTCAGCACGCCATGCAGTTCCCCGCCGAGCTGACCCGGGACGCCTGCAA
GACCCGCCCCAGGGAGCTGCGGCTCATCTGTATCTACTTCTCCAACACCCACTTTTTCAAGGATGAAAACAACTC
ATCTCTGCTGAATAACTACGTCCTGGGGGCCCAGCTGAGTCATGGGCACGTGAACAACCTCAGGGATCCTGTGAA
CATCAGCTTCTGGCACAACCAAAGCCTGGAAGGCTACACCCTGACCTGTGTCTTCTGGAAGGAGGGAGCCAGGAA
ACAGCCCTGGGGGGGCTGGAGCCCTGAGGGCTGTCGTACAGAGCAGCCCTCCCACTCTCAGGTGCTCTGCCGCTG
CAACCACCTCACCTACTTTGCTGTTCTCATGCAACTCTCCCCAGCCCTGGTCCCTGCAGAGTTGCTGGCACCTCT
TACGTACATCTCCCTCGTGGGCTGCAGCATCTCCATCGTGGCCTCGCTGATCACAGTCCTGCTGCACTTCCATTT
CAGGAAGCAGAGTGACTCCTTAACACGTATCCACATGAACCTGCATGCCTCCGTGCTGCTCCTGAACATCGCCTT
CCTGCTGAGCCCCGCATTCGCAATGTCTCCTGTGCCCGGGTCAGCATGCACGGCTCTGGCCGCTGCCCTGCACTA
CGCGCTGCTCAGCTGCCTCACCTGGATGGCCATCGAGGGCTTCAACCTCTACCTCCTCCTCGGGCGTGTCTACAA
CATCTACATCCGCAGATATGTGTTCAAGCTTGGTGTGCTAGGCTGGGGGGCCCCAGCCCTCCTGGTGCTGCTTTC
CCTCTCTGTCAAGAGCTCGGTATACGGACCCTGCACAATCCCCGTCTTCGACAGCTGGGAGAATGGCACAGGCTT
CCAGAACATGTCCATATGCTGGGTGCGGAGCCCCGTGGTGCACAGTGTCCTGGTCATGGGCTACGGCGGCCTCAC
GTCCCTCTTCAACCTGGTGGTGCTGGCCTGGGCGCTGTGGACCCTGCGCAGGCTGCGGGAGCGGGCGGATGCACC
AAGTGTCAGGGCCTGCCATGACACTGTCACTGTGCTGGGCCTCACCGTGCTGCTGGGAACCACCTGGGCCTTGGC
CTTCTTTTCTTTTGGCGTCTTCCTGCTGCCCCAGCTGTTCCTCTTCACCATCTTAAACTCGCTGTACGGTTTCTT
CCTTTTCCTGTGGTTCTGCTCCCAGCGGTGCCGCTCAGAAGCAGAGGCCAAGGCACAGATAGAGGCCTTCAGCTC
CTCCCAAACAACACAGTAGTCCGGGCCTCCTGGCCTGGAATCCTCAGCCTCTCTGGCCGCCAGTAGCCTGAGGCT
ACGGCTCCTGCTAGAGAGGGTGGCAGGCCTGCTGCTGGACCCCAGAGGCCACTGTGACCGCCAAGGGGCCTTTTC
CACTTCCACGGCCTCTCCAGGCACTGAGGGGAAGGCATTGCTCTACCTCTCCCTGACATTTTGCTCCGGGGCAGA
TCCAACCTTACCTGGGGCAGCAAACTTTGTCCTGGTACCTGGGCCCAGCTCGCCCAGGGATGTGGGCAGAGCACCA
GCCTGGGCATCAGGAAGCCAAGTTTCAAGGACTGTCTTTGAGTCTGTCTGTATGACCTTGGGCCTGCCACTTCTC
ACAGACCCTAGGTATCCACAGCTGTGACATGGGGGCAAGCAGCTTTGTTTCAGCCTAACCCAGGAGCTTAGTAAA
AATTGCATAAGACCAGGGGGAAGAGTGTCAGCGTGGGGTGGGAATTCCCGCGGCCTCCACCTGCTTGCTAGGGGC
AGGATCTCATTCAGGCTGCCCTGGAAGCACCTGCTTGGCCCTGCCACCTTCCTCCAGGGGAGGGCCAGATGGCAT
CCTGGCTTGGGGCGGGTGGGACCTACCCAGGCTCTGAGACTTTACTGGCCTATGCCTGAGGCCTCTTTTCCTTTA
ACTCCCTAAATTATGATGACTCCAAGTCCAAGCCCACCCTTCCCAAAGATTGGGAGGTTCCGCCGTTCCCAGAGG
CTCCTCCTGCGGTGCTCCCAAGACTTCCATAGACCATCTGGACCAGTAGCCCATCCCGCAGTTTTCTTGGGGGCA
GAGGAAAACGCTTCTTTCTCCTCCAGCTGAATCAGCTGGATCCCAGTGTCCTGGCTGTTTGGTGATTGGCAAGA
TTGAATTTGCCCAGGTAGGCGTGAGAGTGTGGGTTTTAAATTCGAAGCTCAGGCCATAGTTTCAGAGAATCACCC
TTACCCCAGACCTTCATGAGACAGTGCTCATGAAGCCAGTGCGTTTCCCAGAACGAACACTAGGCGGCACCGTTG
GTCCACACTCAGAGGCCCTTGGCGCCAAGACTGCATCTAGAATCGCTCAAACACCTGTTTGCAGACCCCATGCAC
CAGCTGGAGGGGCCGTAACTGCAGGACTGCGCCTACTGAGTGACCCATTTCCTCCAGGAGGAAAGGCAAGACACG
CTTACACGGCCATTTGTCTCTTTTCCCAATGCGGCGGTGCACTTTCGCTCTTGGGGGCTGCACCCCAGACATAGC
TGGCACCAGAGCAGGGTGCTCAGGTGGTGGGTGCTCAGGGCCCTGCCCCAGGCCACTGGGCCGTTTTGATGACCT
CAAAGGTCACAGGCAGAAAATAGGAGCAGGATTTCCCCTGGGGAAAAGTTATCCTGGGACATCTTCTGCTCTTCT
GTACATTTCTAGATGCAAATAACTCCTTCACCAGGCAGTGAGTGGCGTAGGCTCTGGAGCCAGGCTGCCTGGGCT
CCAATGCCAGCTCTGCCACTTGCTAGCTGTGAGACTGTGGACAAACCACTCAGCCTCTGTGTGCCTCAGTTTTCC
TATTTGTAAAATAGAGACCATAGTGGTACCTATTTTGAAGACTAAGTAAAAGAATTCAAATAAAGAGACTTGGCA
CAGAGTAAGTGCTCAGTAAAAA

FIGURE 490

></usr/seqdb2/sst/DNA/Dnaseqs.min/ss.DNA96860
><subunit 1 of 1, 528 aa, 1 stop
><MW: 59000, pI: 8.73, NX(S/T): 9
MDHCGALFLCLCLLTLQNATTETWEELLSYMENMQVSRGRSSVFSSRQLHQLEQMLLNTS
FPGYNLTLQTPTIQSLAFKLSCDFSGLSLTSATLKRVPQAGGQHARGQHAMQFPAELTRD
ACKTRPRELRLICIYFSNTHFFKDENNSSLLNNYVLGAQLSHGHVNNLRDPVNISFWHNQ
SLEGYTLTCVFWKEGARKQPWGGWSPEGCRTEQPSHSQVLCRCNHLTYFAVLMQLSPALV
PAELLAPLTYISLVGCSISIVASLITVLLHFHFRKQSDSLTRIHMNLHASVLLLNIAFLL
SPAFAMSPVPGSACTALAAALHYALLSCLTWMAIEGFNLYLLLGRVYNIYIRRYVFKLGV
LGWGAPALLVLLSLSVKSSVYGPCTIPVFDSWENGTGFQNMSICWVRSPVVHSVLVMGYG
GLTSLFNLVVLAWALWTLRRLRERADAPSVRACHDTVTVLGLTVLLGTTWALAFFSFGVF
LLPQLFLFTILNSLYGFFLFLWFCSQRCRSEAEAKAQIEAFSSSQTTQ

Important features of the protein:
Signal peptide:
Amino acids 1-21

Transmembrane domains:
Amino acids 244-264;290-309;316-344;358-376;411-431;468-491

N-glycosylation sites:
Amino acids 18-22;58-62;65-69;146-150;147-151;173-177;
179-183;394-398;400-404 cAMP- and cGMP-dependent protein kinase phosphorylation site:
Amino acids 274-278

N-myristoylation sites:
86 GLSLTS
101 GGQHAR
157 GAQLSH
255 GCSISI
311 GSACTA
420 GGLTSL
467 GTTWAL

Prokaryotic membrane lipoprotein lipid attachment sites:
Amino acids 246-257;318-329

Eukaryotic thiol (cysteine) proteases histidine active site:
Amino acids 410-421

G-protein coupled receptors family 2 proteins:
Amino acids 273-302;314-343

FIGURE 491

CTTGGCTGCCCGACAACAAGCTCGCCACCTGCGCTGGGCGCATCCACCATCCAAGGCCCAGCT
GAGGGGCACCAGACAGAGGATGAGGAGAGAGAGTCGCACACGGGCTGCCCTGAGAGACATTTC
CATGGACATCCTCATGCTGCTTCTGCTTTTGTGTGTAATATATGGGAGATTTTCCCAAGATGA
ATACTCCCTCAATCAAGCTATCCGGAAAGAATTTACAAGAAATGCCAGAAACTGCTTGGGTGG
CCTGAGAAACATCGCTGACTGGTGGGACTGGAGTCTGACCACACTTCTGGATGGCCTGTACCC
GGGAGGCACCCCGTCAGCCCGTGTGCCGGGGGCTCAGCCTGGAGCTCTTGGAGGAAAATGCTA
CCTAATAGGCAGTTCCGTAATTAGGCAGCTAAAAGTTTTTCCTAGGCATTTATGCAAGCCTCC
CAGGCCATTTTCAGCACTCATCGAAGACTCTATTCCTACATGTAGTCCCGAAGTTGGAGGCCC
TGAGAACCCCTACCTGATAGACCCAGAGAACCAAAACGTGACCCTGAATGGTCCTGGGGGCTG
TGGGACAAGGGAGGACTGTGTGCTCAGCCTGGGCAGAACAAGGACTGAAGCCCACACAGCCCT
GTCCCGACTCAGGGCCAGCATGTGGATTGACCGCAGCACCAGGGCTGTGTCTGTGCACTTCAC
TCTCTATAACCCTCCAACCCAACTCTTCACCAGCGTGTCCCTGAGAGTGGAGATCCTCCCTAC
GGGGAGTCTCGTCCCCTCATCCCTGGTGGAGTCATTCAGCATCTTCCGCAGCGACTCAGCCCT
GCAGTACCACCTCATGCTTCCCCAGCTGGTCTTCCTGGCACTCAGCCTGATCCACCTCTGTGT
TCAACTCTACCGTATGATGGACAAGGGCGTCCTCAGCTACTGGCGAAAGCCAAGGAACTGGCT
GGAGGTAGCCTCTCTTGTGTCATTTTCTTTTGAAAAATAACAATAAACTGTTTATATCTTGAA
AAAATAATTTAAATAAGAAATTGATTATGCACTAGCTACTGCCAACATTATTGCAGTTTTCTC
CCTCTGTAGTGTTAATCTCAAAACAGCATTTGAGATCAGGTATCATTTAGTGTTGTTACAGTT
ACCGTCATGTACCACACGAATTTCAGCCAAGGTGGTGGTCCCATAAGATCATATGGTGCTAAG
AAATTTCTGTCACCTAATGACATCTTGATTCTGACCTTGTATGTAGGCCTAGGCTAAATATGT
CTGTTTGTATCTTAGCTTTTAATAAAGAAGTTTAAAAATAAAAAA

FIGURE 492

></usr/seqdb2/sst/DNA/Dnaseqs.min/ss.DNA96861
><subunit 1 of 1, 300 aa, 1 stop
><MW: 33649, pI: 9.26, NX(S/T): 1
MRRESRTRAALRDISMDILMLLLLLCVIYGRFSQDEYSLNQAIRKEFTRNARNCLGGLRN
IADWWDWSLTTLLDGLYPGGTPSARVPGAQPGALGGKCYLIGSSVIRQLKVFPRHLCKPP
RPFSALIEDSIPTCSPEVGGPENPYLIDPENQNVTLNGPGGCGTREDCVLSLGRTRTEAH
TALSRLRASMWIDRSTRAVSVHFTLYNPPTQLFTSVSLRVEILPTGSLVPSSLVESFSIF
RSDSALQYHLMLPQLVFLALSLIHLCVQLYRMMDKGVLSYWRKPRNWLEVASLVSFSFEK

Important features of the protein:
Signal peptide:
Amino acids 1-30

Transmembrane domain:
Amino acids 250-267

N-glycosylation site:
Amino acids 153-157 cAMP- and cGMP-dependent protein kinase phosphorylation site:
Amino acids 2-6

N-myristoylation sites:
Amino acids 56-62;75-81;79-85;80-86;88-94;92-98;160-166

FIGURE 493

TCTCAGGGCTTCATACAGGAAATCTATTGCTGTGTCAAGTTCCAGAGAAAAGCTTCTGTTCGT
CCAAGTTACTAACCAGGCTAAACCACATAGACGTGAAGGAAGGGGCTAGAAGGAAGGGAGTGC
CCCACTGTTGATGGGGTAAGAGGATCCTGTACTGAGAAGTTGACCAGAGAGGGTCTCACCATG
CGCACAGTTCCTTCTGTACCTGTGTGGAGGAAAAGTACTGAGTGAAGGGCAGAAAAAGAGAAA
ACAGAAATGCTCTGCCCTTGGAGAACTGCTAACCTAGGGCTACTGTTGATTTTGACTATCTTC
TTAGTGGCCGAAGCGGAGGGTGCTGCTCAACCAAACAACTCATTAATGCTGCAAACTAGCAAG
GAGAATCATGCTTTAGCTTCAAGCAGTTTATGTATGGATGAAAAACAGATTACACAGAACTAC
TCGAAAGTACTCGCAGAAGTTAACACTTCATGGCCTGTAAAGATGGCTACAAATGCTGTGCTT
TGTTGCCCTCCTATCGCATTAAGAAATTTGATCATAATAACATGGGAAATAATCCTGAGAGGC
CAGCCTTCCTGCACAAAAGCCTACAGGAAAGAAACAAATGAGACCAAGGAAACCAACTGTACT
GATGAGAGAATAACCTGGGTCTCCAGACCTGATCAGAATTCGGACCTTCAGATTCGTCCAGTG
GCCATCACTCATGACGGGTATTACAGATGCATAATGGTAACACCTGATGGGAATTTCCATCGT
GGATATCACCTCCAAGTGTTAGTTACACCTGAACTGACCCTGTTTCAAAACAGGAATAGAACT
GCAGTATGCAAGGCAGTTGCAGGGAAGCCAGCTGCGCAGATCTCCTGGATCCCAGAGGGCGAT
TGTGCCACTAAGCAAGAATACTGGAGCAATGGCACAGTGACTGTTAAGAGTACATGCCACTGG
GAGGTCCACAATGTGTCTACCGTGACCTGCCACGTCTCCCATTTGACTGGCAACAAGAGTCTG
TACATAGAGCTACTTCCTGTTCCAGGTGCCAAAAAATCAGCAAAATTATATATTCCATATATC
ATCCTTACTATTATTATTTTGACCATCGTGGGATTCATTTGGTTGTTGAAAGTCAATGGCTGC
AGAAAATATAAATTGAATAAAACAGAATCTACTCCAGTTGTTGAGGAGGATGAAATGCAGCCC
TATGCCAGCTACACAGAGAAGAACAATCCTCTCTATGATACTACAAACAAGGTGAAGGCATCT
CAGGCATTACAAAGTGAAGTTGACACAGACCTCCATACTTTATAAGTTGTTGGACTCTAGTAC
CAAGAAACAACAACAAACGAGATACATTATAATTACTGTCTGATTTTCTTACAGTTCTAGAAT
GAAGACTTATATTGAAATTAGGTTTTCCAAGGTTCTTAGAAGACATTTTAATGGATTCTCATT
CATACCCTTGTATAATTGGAATTTTTGATTCTTAGCTGCTACCAGCTAGTTCTCTGAAGAACT
GATGTTATTACAAAGAAAATACATGCCCATGACCAAATATTCAAATTGTGCAGGACAGTAAAT
AATGAAAACCAAATTTCCTCAAGAAATAACTGAAGAAGGAGCAAGTGTGAACAGTTTCTTGTG
TATCCTTTCAGAATATTTTAATGTACATATGACATGTGTATATGCCTATGGTATATGTGTCAA
TTTATGTGTCCCCTTACATATACATGCACATATCTTTGTCAAGGCACCAGTGGGAACAATACA
CTGCATTACTGTTCTATACATATGAAAACCTAATAATATAAGTCTTAGAGATCATTTTATATC
ATGACAAGTAGAGCTACCTCATTCTTTTTAATGGTTATATAAAATTCCATTGTATAGTTATAT
CATTATTTAATTAAAAACAACCCTAATGATGGATATTTAGATTCTTTTAAGTTTTGTTTATTT
CTTTTAAGTTTTGTTTGTGGTATAAACAATACCACATAGAATGTTTCTTGTTCATATATCTCT
TTGTTTTTGAGTATATCTGTAGGATAACTTTCTTGAGTGGAATTGTCAGGTCAAAGGGTTTGT
GCATTTTACTATTGATATATATGTTAAATTGTGTCAAATATATATGTCAAATTCCCTCCAACA
TTGTTTAAATGTGCCTTTCCCTAAATTTCTATTTTAATAACTGTACTATTCCTGCTTCTACAG
TTGCCACTTTCTCTTTTTAATCAACCAGATTAAATATGATGTGAGATTATAATAAGAATTATA
CTATTTAATAAAAATGGATTTATA

FIGURE 494

```
></usr/seqdb2/sst/DNA/Dnaseqs.min/ss.DNA96866
><subunit 1 of 1, 348 aa, 1 stop
><MW: 39069, pI: 8.13, NX(S/T): 10
MLCPWRTANLGLLLILTIFLVAEAEGAAQPNNSLMLQTSKENHALASSSLCMDEKQITQN
YSKVLAEVNTSWPVKMATNAVLCCPPIALRNLIIITWEIILRGQPSCTKAYRKETNETKE
TNCTDERITWVSRPDQNSDLQIRPVAITHDGYYRCIMVTPDGNFHRGYHLQVLVTPELTL
FQNRNRTAVCKAVAGKPAAQISWIPEGDCATKQEYWSNGTVTVKSTCHWEVHNVSTVTCH
VSHLTGNKSLYIELLPVPGAKKSAKLYIPYIILTIIILTIVGFIWLLKVNGCRKYKLNKT
ESTPVVEEDEMQPYASYTEKNNPLYDTTNKVKASQALQSEVDTDLHTL

Important features of the protein:
Signal peptide:
Amino acids    1-24

Transmembrane domains:
Amino acids    78-98;267-286

N-glycosylation sites:
Amino acids    31-35;60-64;69-73;116-120;122-126;185-189;
               218-222;233-237;247-251;298-302

cAMP- and cGMP-dependent protein kinase phosphorylation site:
Amino acids    112-116

N-myristoylation sites:
Amino acids    103-109;259-265
```

FIGURE 495

CCAGGTGCACAGCGCATCGCCCGAGGCTGTCACCGCCCTGCCCCGCCCACCCCAGCTGTCCTG
GACCCAGGGGCAGGGAGAGGCTGGACGCCAGGTGCGCGGACACAGAAGCGTCTAAGCACAGCT
TCCTCCTTGCCGCTCCGGGAAGTGGGCAGCCAGCCCAGGAACCAGTACCACCTGCACCATGGG
GCTGTCCCGGAAGGAGCAGGTCTTCTTGGCCCTGCTGGGGGCCTCGGGGGTCTCAGGCCTCAC
GGCACTCATTCTCCTCCTGGTGGAGGCCACCAGCGTGCTCCTGCCCACAGACATCAAGTTTGG
GATCGTGTTTGATGCGGGCTCCTCCCACACGTCCCTCTTCCTGTATCAGTGGCCGGCGAACAA
GGAGAATGGCACGGGTGTGGTCAGCCAGGCCCTGGCCTGCCAGGTGGAAGGGCCTGGAATCTC
CTCCTACACTTCTAATGCTGCACAGGCTGGTGAGAGCCTGCAGGGCTGCTTGGAGGAGGCGCT
GGTGCTGATCCCAGAGGCCCAGCATCGGAAAACACCCACGTTCCTGGGGGCCACGGCTGGCAT
GAGGTTGCTCAGCCGGAAGAACAGCTCTCAGGCCAGGGACATCTTTGCAGCAGTCACCCAGGT
CCTGGGCCGGTCTCCCGTGGACTTTTGGGGTGCCGAGCTCCTGGCCGGGCAGGCCGAAGGTGC
CTTTGGTTGGATCACTGTCAACTACGGCTTGGGGACGCTGGTCAAGTACTCCTTCACTGGAGA
ATGGATCCAGCCTCCGGAGGAGATGCTGGTGGGTGCCCTGGACATGGGAGGGGCCTCCACCCA
GATCACGTTCGTGCCTGGGGGCCCCATCTTGGACAAGAGCACCCAGGCCGATTTTCGCCTCTA
CGGCTCCGACTACAGCGTCTACACTCACAGCTACCTGTGCTTTGGACGGGACCAGATGCTGAG
CAGGCTCCTCGTGGGGCTGGTGCAGAGCCGCCCGGCTGCCCTGCTCCGTCACCCGTGCTACCT
CAGCGGCTACCAGACCACACTGGCCCTGGGCCCGCTGTATGAGTCACCCTGTGTCCACGCCAC
GCCCCCGCTGAGCCTCCCCCAGAACCTCACAGTTGAAGGGACAGGCAACCCTGGAGCCTGCGT
CTCAGCCATCCGGGAACTTTTCAACTTCTCCAGCTGCCAGGGCCAGGAGGACTGCGCCTTTGA
CGGGGTCTACCAGCCCCCGCTGCGGGGCCAGTTCTATGTGGAGGCCAGCTACCCTGGGCAGGA
CCGCTGGCTGCGGGACTACTGTGCCTCAGGCCTGTACATCCTCACCCTCCTGCACGAGGGCTAC
GGGTTCAGCGAGGAGACCTGGCCCAGCCTCGAGTTCCGAAAGCAGGCGGGCGGTGTGGACATT
GGCTGGACACTGGGCTACATGCTGAACCTGACCGGGATGATCCCGGCCGATGCGCCGGCTCAG
TGGCGGGCAGAGAGCTACGGCGTCTGGGTGGCCAAAGTGGTGTTCATGGTGCTGGCCCTGGTG
GCGGTGGTGGGGGCTGCCTTGGTCCAGCTCTTCTGGTTGCAGGACTAGTGGGAAGGCGGAGGT
GGGCCCCCACAGAGCCCACAGGCAGCTGCGTCCCGGATGCTGGAGGCTTCCTGAGCCCTGAGC
GCCGTGGGGCCTTGCTCTGTGGCTCTGCCCACGGTCAGGTGACAGCCACCTCCAGGGCACCGT
CAGGGTGGTGCTGGCCACAGAGGCTGCATGACCTCCCCTCCCGGCGTCCCTCCCCCAACCTCC
TTCCGCAACTGGGCTTCCAGGGCCGTAGGTGCCTTTCTGCACACAGGCCGCCAGGACTCGTGG
TGTCTCCAGGCTGTGTGACTGCAGGGCCACATGCTGCCTGCAAACAGGGCAAGACCACGGAGG
CACAGGGGTCCTGCTCCTGATGGGGCCTCAGGAGGGGCGGAGAGGGGTGGAAGGGAGGGAGCT
GCCCCACCTGGACCCCCGCTCTCCCTGCTGTTGTCTGAGCAGATGGATGGAGTCCAGGCCTGG
GGGCTTCTGCTGGGCCAGCCCGGCCTCCCACACCCACTTGGAGGGTGAGACTGCAGTGGGGGT
TGTTTTTATTAAAAGCATCATGGACACAGCAAAAAAAAAAAAAAAA

FIGURE 496

></usr/seqdb2/sst/DNA/Dnaseqs.min/ss.DNA96870
><subunit 1 of 1, 458 aa, 1 stop
><MW: 49377, pI: 4.98, NX(S/T): 5
MGLSRKEQVFLALLGASGVSGLTALILLLVEATSVLLPTDIKFGIVFDAGSSHTSLFLYQ
WPANKENGTGVVSQALACQVEGPGISSYTSNAAQAGESLQGCLEEALVLIPEAQHRKTPT
FLGATAGMRLLSRKNSSQARDIFAAVTQVLGRSPVDFWGAELLAGQAEGAFGWITVNYGL
GTLVKYSFTGEWIQPPEEMLVGALDMGGASTQITFVPGGPILDKSTQADFRLYGSDYSVY
THSYLCFGRDQMLSRLLVGLVQSRPAALLRHPCYLSGYQTTLALGPLYESPCVHATPPLS
LPQNLTVEGTGNPGACVSAIRELFNFSSCQGQEDCAFDGVYQPPLRGQFYVEASYPGQDR
WLRDYCASGLYILTLLHEGYGFSEETWPSLEFRKQAGGVDIGWTLGYMLNLTGMIPADAP
AQWRAESYGVWVAKVVFMVLALVAVVGAALVQLFWLQD

Important features of the protein:
Signal peptide:
Amino acids 1-21

Transmembrane domain:
Amino acids 428-449

N-glycosylation sites:
Amino acids 67-71;135-139;304-308;325-329;410-414 cAMP- and cGMP-dependent protein kinase phosphorylation site:
Amino acids 133-137

N-myristoylation sites:
Amino acids 50-56;123-127;165-171;207-213;234-240;
259-265;311-317;314-320;331-337;398-404;
413-419;429-435

GDA1/CD39 family of nucleoside phosphatases proteins:
Amino acids 43-59;202-215

FIGURE 497

GCCTTATAAAGTAGCCTCTGCATCTGCCTGCCTCGGGCAGAGGAGGGCTACCCTGGGGCTGAG
AGTTCACCTGTCTCAGGAACCACCTGAGCCCACAGATCCTGTGGGCAGCGGCCAGGGCAGCCA
TGGCTTGGGCAAGTAGGCTGGGCCTGCTGCTGGCACTGCTGCTGCCCGTGGTCGGTGCCTCCA
CGCCAGGCACCGTGGTCCGACTCAACAAGGCAGCATTGAGCTACGTGTCTGAAATTGGGAAAG
CCCCTCTCCAGCGGGCCCTGCAGGTCACTGTCCCTCATTTCCTGGACTGGAGTGGAGAGGCGC
TTCAGCCCACCAGGATCCGGATTCTGAATGTCCATGTGCCCCGCCTCCACCTGAAATTCATTG
CTGGTTTCGGAGTGCGCCTGCTGGCAGCAGCTAATTTTACTTTCAAGGTCTTTCGCGCCCCAG
AGCCCCTGGAGCTGACGCTGCCTGTGGAACTGCTGGCTGACACCCGCGTGACCCAGAGCTCCA
TCAGGACCCCTGTGGTCAGCATCTCTGCCTGCTCTTTATTCTCGGGCCACGCCAACGAGTTTG
ATGGCAGTAACAGCACCTCCCACGCGCTGCTGGTCCTGGTGCAGAAGCACATTAAAGCTGTCT
TGAGTAACAAGCTGTGCCTGAGCATCTCCAACCTGGTGCAGGGTGTCAATGTCCACCTGGGCA
CCTTAATTGGCCTCAACCCCGTGGGTCCTGAGTCCCAGATCCGCTATTCCATGGTCAGTGTGC
CCACTGTCACCAGTGACTACATTTCCCTGGAAGTCAATGCTGTTCTCTTCCTGCTGGGCAACC
CCATCATCCTGCCCACGGATGCCACCCCTTTTGTGTTGCCAAGGCATGTGGGTACCGAGGGCT
CCATGGCCACCGTGGGCCTCTCCCAGCAGCTGTTTGACTCTGCGCTCCTGCTGCTGCAGAAGG
CCGGTGCCCTCAACCTGGACATCACAGGGCAGCTGAGGTCGGATGACAACCTGCTGAACACCT
CTGCTCTGGGCCGGCTCATCCCGGAGGTGGCCCGCCAGTTTCCCGAGCCCATGCCTGTGGTGC
TCAAGGTGCGGCTGGGTGCCACACCTGTGGCCATGCTCCACACAAACAACGCCACCCTGCGGC
TGCAGCCCTTCGTGGAGGTCCTGGCCACAGCCTCCAACTCGGCTTTCCAGTCCCTCTTCTCCC
TGGATGTGGTAGTGAACTTGAGACTCCAGCTCTCTGTGTCCAAGGTGAAGCTTCAGGGGACCA
CGTCTGTGCTGGGGGATGTCCAGCTCACGGTGGCCTCCTCCAACGTGGGCTTCATTGATACAGAT
CAGGTGCGCACACTGATGGGCACCGTTTTTGAGAAGCCCCTGCTGGACCATCTCAATGCTCTC
TTGGCCATGGGAATTGCCCTCCCTGGTGTGGTCAACCTCCACTATGTTGCCCCTGAGATCTTT
GTCTATGAGGGCTACGTGGTGATATCCAGTGGACTCTTCTACCAGAGCTGAGGCAAGACCACT
GGGAGGCCTGAGAGTGGGCCAGCTCGCTGCTCAGGCGAATTTCTCATTTCAAGCCACTGGGGA
AACTGAGGCAAAACCATACTTAGTCATCACCAACAAGCTGGACTGCTTAGCTGGGCTGTTTTA
TCTTCCCTGAGTGCCTGGGTCTCCCTCCCTCACTTCTGCCCTTTCCCTTCCTCCTCCTCTTCT
CCTCCCTCTTCCCTCATCTCCCCCCTCCTTCCTCTGCCCCACCCCAGGGGGGAGCAGACTGCT
CCTCCAGGCTGTATAGACCTGCCCTCTTGCATTAAACAACTTCTCTTGAGCTGC

FIGURE 498

></usr/seqdb2/sst/DNA/Dnaseqs.min/ss.DNA96872
><subunit 1 of 1, 458 aa, 1 stop
><MW: 49158, pI: 8.72, NX(S/T): 4
MAWASRLGLLLALLLPVVGASTPGTVVRLNKAALSYVSEIGKAPLQRALQVTVPHFLDWS
GEALQPTRIRILNVHVPRLHLKFIAGFGVRLLAAANFTFKVFRAPEPLELTLPVELLADT
RVTQSSIRTPVVSISACSLFSGHANEFDGSNSTSHALLVLVQKHIKAVLSNKLCLSISNL
VQGVNVHLGTLIGLNPVGPESQIRYSMVSVPTVTSDYISLEVNAVLFLLGNPIILPTDAT
PFVLPRHVGTEGSMATVGLSQQLFDSALLLLQKAGALNLDITGQLRSDDNLLNTSALGRL
IPEVARQFPEPMPVVLKVRLGATPVAMLHTNNATLRLQPFVEVLATASNSAFQSLFSLDV
VVNLRLQLSVSKVKLQGTTSVLGDVQLTVASSNVGFIDTDQVRTLMGTVFEKPLLDHLNA
LLAMGIALPGVVNLHYVAPEIFVYEGYVVISSGLFYQS

Important features of the protein:
Signal peptide:
Amino acids 1-20

Transmembrane domain:
Amino acids 217-236

N-glycosylation sites:
Amino acids 96-100;151-155;293-297;332-336

N-myristoylation sites:
Amino acids 8-14;149-155;189-195;249-255;252-258;283-289

LBP / BPI / CETP family proteins:
Amino acids 22-50; 251-287

FIGURE 499

TTGAAAATCTACTCTATCAGCTGCTGTGGTTGCCACCATTCTCAGGACCCTCGCCATGAAAGC
CCTTATGCTGCTCACCCTGTCTGTTCTGCTCTGCTGGGTCTCAGCTGACATTCGCTGTCACTC
CTGCTACAAGGTCCCTGTGCTGGGCTGTGTGGACCGGCAGTCCTGCCGCCTGGAGCCAGGACA
GCAATGCCTGACAACACATGCATACCTTGGTAAGATGTGGGTTTTCTCCAATCTGCGCTGTGG
CACACCAGAAGAGCCCTGTCAGGAGGCCTTCAACCAAACCAACCGCAAGCTGGGTCTGACATA
TAACACCACCTGCTGCAACAAGGACAACTGCAACAGCGCAGGACCCCGGCCCACTCCAGCCCT
GGGCCTTGTCTTCCTTACCTCCTTGGCTGGCCTTGGCCTCTGGCTGCTGCACTGAGACTCATT
CCATTGGCTGCCCCTCCTCCCACCTGCCTTGGCCTGAGCCTCTCTCCCTGTGTCTCTGTATCC
CCTGGCTTTACAGAATCGTCTCTCCCTAGCTCCCATTTCTTTAATTAAACACTGTTCCGAGTG
GTCTCCTCATCCATCCTTCCCACCTCACACCCTTCACTCTCCTTTTTCTGGGTCCCTTCCCAC
TTCCTTCCAGGACCTCCATTGGCTCCTAGAAGGGCTCCCCACTTTGCTTCCTATACTCTGCTG
TCCCCTACTTGAGGAGGGATTGGGATCTGGGCCTGAAATGGGGCTTCTGTGTTGTCCCCAGTG
AAGGCTCCCACAAGGACCTGATGACCTCACTGTACAGAGCTGACTCCCCAAACCCAGGCTCCC
ATATGTACCCCATCCCCCATACTCACCTCTTTCCATTTTGAGTAATAAATGTCTGAGTCTGGA
AAAAAAAAAAAAAAAAA

FIGURE 500

></usr/seqdb2/sst/DNA/Dnaseqs.min/ss.DNA96878
><subunit 1 of 1, 125 aa, 1 stop
><MW: 13821, pI: 8.60, NX(S/T): 2
MKALMLLTLSVLLCWVSADIRCHSCYKVPVLGCVDRQSCRLEPGQQCLTTHAYLGKMWVFSNL
RCGTPEEPCQEAFNQTNRKLGLTYNTTCCNKDNCNSAGPRPTPALGLVFLTSLAGLGLWLLH

Important features of the protein:
Signal peptide:
amino acids 1-18

N-glycosylation sites.
amino acids 77-81, 88-92

N-myristoylation site.
amino acids 84-90

Ly-6 / u-PAR domain protein signature.
amino acids 85-98

FIGURE 501

GGAGCCTCCTAATGCAGTCTTCTGCACAGTCCTGGGGACTGACTGACTGAATCACACCTCTGG
GGCTGGGGGCTGCTGACATGTGTGCCTTTCCTTGGCTGCTTCTTCTCCTGCTGCTCCAGGAGG
GCAGCCAAAGGAGACTCTGGAGATGGTGTGGATCCGAGGAAGTGGTTGCGGTCCTTCAGGAGT
CCATCAGCCTCCCCCTGGAAATACCACCAGATGAAGAGGTTGAGAACATCATCTGGTCCTCTCAC
AAAAGTCTTGCCACTGTGGTGCCAGGGAAAGAGGGACATCCAGCTACCATCATGGTGACCAAT
CCACACTACCAGGGCCAAGTGAGCTTCCTGGACCCCAGCTATTCCCTGCATATCAGCAATCTG
AGCTGGGAGGATTCAGGGCTTTACCAAGCTCAAGTCAACCTGAGAACATCCCAGATCTCTACC
ATGCAGCAGTACAATCTATGTGTCTACCATCCTAACTATGCTTCTGAGAAGCCTTCAACAGCC
TTCTGCCTCCTGGCCAAGGGATTGCTCATCTTCTTGCTCTTGGTAATTCTGGCCATGGGACTC
TGGGTCATCCGAGTCCAGAAAAGACACAAAATGCCAAGGATGAAGAAACTCATGAGAAACAGA
ATGAAATTGAGGAAGGAGGCAAAGCCTGGCTCCAGCCCTGCCTGACTGCTCCTTGGGAACCCC
AGTCCTGAGCTTGGTTTCTTCCCAGCACCCAGAGAATCCTTCCTCAGCTCTCTTCTTTCCAGG
GGAAGGAGGTGCTCAGGGGTGGGTATCCAGAGAGCCATACTTCTGAGGGAAGACTGGCTGGCA
ATAAAGTCAAATTAAGTGACCACA

FIGURE 502

></usr/seqdb2/sst/DNA/Dnaseqs.min/ss.DNA96879
><subunit 1 of 1, 198 aa, 1 stop
><MW: 22584, pI: 9.40, NX(S/T): 1
MCAFPWLLLLLLLQEGSQRRLWRWCGSEEVVAVLQESISLPLEIPPDEEVENIIWSSHKS
LATVVPGKEGHPATIMVTNPHYQGQVSFLDPSYSLHISNLSWEDSGLYQAQVNLRTSQIS
TMQQYNLCVYHPNYASEKPSTAFCLLAKGLLIFLLLVILAMGLWVIRVQKRHKMPRMKKL
MRNRMKLRKEAKPGSSPA

Important features of the protein:
Signal peptide:
Amino acids 1-18

Transmembrane domain:
Amino acids 144-165

N-glycosylation site:
Amino acids 99-103

N-myristoylation site:
Amino acids 106-112

FIGURE 503

ACGGGCCGCAGCGGCAGTGACGTAGGGTTGGCGCACGGATCCGTTGCGGCTGCAGCTCTGCAG
TCGGGCCGTTCCTTCGCCGCCGCCAGGGGTAGCGGTGTAGCTGCGCAGCGTCGCGCGCGCTAC
CGCACCCAGGTTCGGCCCGTAGGCGTCTGGCAGCCCGGCGCCATCTTCATCGAGCGCCATGGC
CGCAGCCTGCGGGCCGGGAGCGGCCGGGTACTGCTTGCTCCTCGGCTTGCATTTGTTTCTGCT
GACCGCGGGCCCTGCCCTGGGCTGGAACGACCCTGACAGAATGTTGCTGCGGGATGTAAAAGC
TCTTACCCTCCACTATGACCGCTATACCACCTCCCGCAGGCTGGATCCCATCCCACAGTTGAA
ATGTGTTGGAGGCACAGCTGGTTGTGATTCTTATACCCCAAAAGTCATACAGTGTCAGAACAA
AGGCTGGGATGGGTATGATGTACAGTGGGAATGTAAGACGGACTTAGATATTGCATACAAATT
TGGAAAAACTGTGGTGAGCTGTGAAGGCTATGAGTCCTCTGAAGACCAGTATGTACTAAGAGG
TTCTTGTGGCTTGGAGTATAATTTAGATTATACAGAACTTGGCCTGCAGAAACTGAAGGAGTC
TGGAAAGCAGCACGGCTTTGCCTCTTTCTCTGATTATTATTATAAGTGGTCCTCGGCGGATTC
CTGTAACATGAGTGGATTGATTACCATCGTGGTACTCCTTGGGATCGCCTTTGTAGTCTATAA
GCTGTTCCTGAGTGACGGGCAGTATTCTCCTCCACCGTACTCTGAGTATCCTCCATTTTCCCA
CCGTTACCAGAGATTCACCAACTCAGCAGGACCTCCTCCCCCAGGCTTTAAGTCTGAGTTCAC
AGGACCACAGAATACTGGCCATGGTGCAACTTCTGGTTTTGGCAGTGCTTTTACAGGACAACA
AGGATATGAAAATTCAGGACCAGGGTTCTGGACAGGCTTGGGAACTGGTGGAATACTAGGATA
TTTGTTTGGCAGCAATAGAGCGGCAACACCCTTCTCAGACTCGTGGTACTACCCGTCCTATCC
TCCCTCCTACCCTGGCACGTGGAATAGGGCTTACTCACCCCTTCATGGAGGCTCGGGCAGCTA
TTCGGTATGTTCAAACTCAGACACGAAAACCAGAACTGCATCAGGATATGGTGGTACCAGGAG
ACGATAAAGTAGAAAGTTGGAGTCAAACACTGGATGCAGAAATTTTGGATTTTTCATCACTTT
CTCTTTAGAAAAAAAGTACTACCTGTTAACAATTGGGAAAAGGGGATATTCAAAAGTTCTGTG
GTGTTATGTCCAGTGTAGCTTTTTGTATTCTATTATTTGAGGCTAAAAGTTGATGTGTGACAA
AATACTTATGTGTTGTATGTCAGTGTAACATGCAGATGTATATTGCAGTTTTTGAAAGTGATC
ATTACTGTGGAATGCTAAAAATACATTAATTTCTAAAACCTGTGATGCCCTAAGAAGCATTAA
GAATGAAGGTGTTGTACTAATAGAAACTAAGTACAGAAAATTTCAGTTTTAGGTGGTTGTAGC
TGATGAGTTATTACCTCATAGAGACTATAATATTCTATTTGGTATTATATTATTTGATGTTTG
CTGTTCTTCAAACATTTAAATCAAGCTTTGGACTAATTATGCTAATTTGTGAGTTCTGATCAC
TTTTGAGCTCTGAAGCTTTGAATCATTCAGTGGTGGAGATGGCCTTCTGGTAACTGAATATTA
CCTTCTGTAGGAAAAGGTGGAAAATAAGCATCTAGAAGGTTGTTGTGAATGACTCTGTGCTGG
CAAAAATGCTTGAAACCTCTATATTTCTTTCGTTCATAAGAGGTAAAGGTCAAATTTTTCAAC
AAAAGTCTTTTAATAACAAAAGCATGCAGTTCTCTGTGAAATCTCAAATATTGTTGTAATAGT
CTGTTTCAATCTTAAAAAGAATCA

FIGURE 504

></usr/seqdb2/sst/DNA/Dnaseqs.min/ss.DNA96889
><subunit 1 of 1, 339 aa, 1 stop
><MW: 36975, pI: 7.85, NX(S/T): 1
MAAACGPGAAGYCLLLGLHLFLLTAGPALGWNDPDRMLLRDVKALTLHYDRYTTSRRLDPIPQ
LKCVGGTAGCDSYTPKVIQCQNKGWDGYDVQWECKTDLDIAYKFGKTVVSCEGYESSEDQYVL
RGSCGLEYNLDYTELGLQKLKESGKQHGFASFSDYYYKWSSADSCNMSGLITIVVLLGIAFVV
YKLFLSDGQYSPPPYSEYPPFSHRYQRFTNSAGPPPPGFKSEFTGPQNTGHGATSGFGSAFTG
QQGYENSGPGFWTGLGTGGILGYLFGSNRAATPFSDSWYYPSYPPSYPGTWNRAYSPLHGGSG
SYSVCSNSDTKTRTASGYGGTRRR

Signal peptide:
amino acids 1-30

Transmembrane domain:
amino acids 171-190

N-glycosylation site.
amino acids 172-176

Glycosaminoglycan attachment sites.
amino acids 244-248, 259-263, 331-335

Tyrosine kinase phosphorylation site.
amino acids 98-106

N-myristoylation sites.
amino acids 68-74, 69-75, 131-137, 241-247, 247-253, 266-272, 270-276, 278-284, 312-318

FIGURE 505

GCAAAAGGAAGGGAGGGAAGCACTCCATCATCTCACTGGGAAGAACGGCACGGGCATACCTGC
AGCTACTGGGGTTCCACTGGGCTTGAGGGTCGATTTTTCACCTTTTGAAGGACAAGATGCATT
GGAAGATGTTGCTGCTTCTGCTGTTGTATTACAATGCTGAGGCTTCTATGTGCCACAGGTGGA
GCAGGGCTGTGCTCTTCCCTGCCGCCCACCGGCCAAAGAGGTCCTCATCACTGCCATTGAACC
CAGTCCTGCAGACCTCCCTGGAGGAGGTGGAGCTGCTCTACGAGTTCCTGCTGGCCGAACTTG
AGATCAGCCCTGACCTGCAGATCTCCATCAAGGACGAGGAGCTGGCCTCCTTGCGGAAGGCCT
CAGACTTCCGCACCGTCTGCAACAACGTCATCCCCAAGAGCATCCCAGACATCCGCCGGCTCA
GCGCCAGCCTCTCCAGCCACCCTGGCATCCTCAAGAAAGAAGACTTTGAAAGGACAGTGCTGA
CCCTGGCCTACACAGCCTACCGCACAGCCCTGTCCCACGGCCATCAGAAGGACATCTGGGCGC
AGTCCCTCGTTAGCCTCTTCCAGGCCCTGAGGCACGACTTGATGCGCTCCTCACAGCCGGGAG
TACCTCCCTGAGAGACTGGCCCACACCAGGACCTCAGAGCAGGGACCAGCACAGTAATCCAGA
AAGTCTTCATTCTCTACTCCATTTACAGAGACCAGCAACAAAACACTTACCGCTGACACAGAG
CAGCAGAGATCAAACAGTAACCCCGATGCTCTTTTCTCCTTGTAGTTTCCTGGAAGACACATC
TGATTCATGCCATCATGTGACCTGGGCTGGAAGAAAGGGCTGGAATGGTCATTCAAGACGCCT
CCATGGGCAGAATGGTTTGCCTATGGCAGGCAGAATTCTGATATGCTTCAACCCAGAGCAGTG
GCCACACACTCAAGAGTGAGAACAGGCGTGAGCCACCGTGCCTGGCCCAGGATCTAAAAACTT
TCTAAGTTTCCTCCATCGTTGGCATCCTCACAGCTATCTCCAATGTCACTCAAGAGACATCAA
CAGACATTTAACTGCTGCAGACTTCATTGCTCTGTCACCTCACCTTGAATCTAACAAATCAAA
GTATTTCTGCAGGTCCAATGGTCTAAAATCAAATGCTTGTTAAATGACTTTTTACAACACCCCTT
ACTTTCCTAATCCATTTCAATCTTATTTTTTTTATTGTGGTAAAAAACACATCACGTAAAATG
TACCATCTTAACCATTTTTAAGCATATGGTACAGCAGTGTTAACTCCATGCATGTTGTGAAAC
AGACCCCCGGAACTTTCTCATCTTGTAATTCTGAAGTTCTATACCCACCGAACAACTCCTCTT
TTCCCCTTCCCCCTGCCTGCCCCAGCTCTTGGCACCATTATTCTGCTTTCTGTTTTTGAGAGT
CTGACTACTTAAGATACCTCATACAAGCGGGATCTGGCTTACATTTCTTGAGCATTGTATTCT
GGAAAAGTGTTTCCTTCCTCTGAAAAATGGGTAGAGTTCTGAAGGAGAACTACTGGTCTTATT
GTACACTTGCTGTACCTATTTTTATTTAACAAATATTCATCTATGGTATAATAAAGATGTCAT
GGTTGGAAAAAAAAAAAAAAAAAAAAAAAAAA

FIGURE 506

></usr/seqdb2/sst/DNA/Dnaseqs.min/ss.DNA96893
><subunit 1 of 1, 173 aa, 1 stop
><MW: 19733, pI: 8.78, NX(S/T): 0
MHWKMLLLLLLYYNAEASMCHRWSRAVLFPAAHRPKRSSSLPLNPVLQTSLEEVELLYEF
LLAELEISPDLQISIKDEELASLRKASDFRTVCNNVIPKSIPDIRRLSASLSSHPGILKK
EDFERTVLTLAYTAYRTALSHGHQKDIWAQSLVSLFQALRHDLMRSSQPGVPP

Important features of the protein:
Signal peptide:
Amino acids 1-17 cAMP- and cGMP-dependent protein kinase phosphorylation sites:
Amino acids 36-40;84-88;105-109

FIGURE 507

GGCGGCGGGCTGCGCGGAGCGGCGTCCCCTGCAGCCGCGGACCGAGGCAGCGGCGGCACCTGC
CGGCCGAGCAATGCCAAGTGAGTACACCTATGTGAAACTGAGAAGTGATTGCTCGAGGCCTTC
CCTGCAATGGTACACCCGAGCTCAAAGCAAGATGAGAAGGCCCAGCTTGTTATTAAAAGACAT
CCTCAAATGTACATTGCTTGTGTTTGGAGTGTGGATCCTTTATATCCTCAAGTTAAATTATAC
TACTGAAGAATGTGACATGAAAAAAATGCATTATGTGGACCCTGACCATGTAAAGAGAGCTCA
GAAATATGCTCAGCAAGTCTTGCAGAAGGAATGTCGTCCCAAGTTTGCCAAGACATCAATGGC
GCTGTTATTTGAGCACAGGTATAGCGTGGACTTACTCCCTTTTGTGCAGAAGGCCCCCAAAGA
CAGTGAAGCTGAGTCCAAGTACGATCCTCCTTTTGGGTTCCGGAAGTTCTCCAGTAAAGTCCA
GACCCTCTTGGAACTCTTGCCAGAGCACGACCTCCCTGAACACTTGAAAGCCAAGACCTGTCG
GCGCTGTGTGGTTATTGGAAGCGGAGGAATACTGCACGGATTAGAACTGGGCCACACCCTGAA
CCAGTTCGATGTTGTGATAAGGTTAAACAGTGCACCAGTTGAGGGATATTCAGAACATGTTGG
AAATAAAACTACTATAAGGATGACTTATCCAGAGGGCGCACCACTGTCTGACCTTGAATATTAT
TCCAATGACTTATTTGTTGCTGTTTTATTTAAGAGTGTTGATTTCAACTGGCTTCAAGCAATG
GTAAAAAAGGAAACCCTGCCATTCTGGGTACGACTCTTCTTTTGGAAGCAGGTGGCAGAAAAA
ATCCCACTGCAGCCAAAACATTTCAGGATTTTGAATCCAGTTATCATCAAAGAGACTGCCTTT
GACATCCTTCAGTACTCAGAGCCTCAGTCAAGGTTCTGGGGCCGAGATAAGAACGTCCCCACA
ATCGGTGTCATTGCCGTTGTCTTAGCCACACATCTGTGCGATGAAGTCAGTTTGGCGGGTTTT
GGATATGACCTCAATCAACCCAGAACACCTTTGCACTACTTCGACAGTCAATGCATGGCTGCT
ATGAACTTTCAGACCATGCATAATGTGACAACGGAAACCAAGTTCCTCTTAAAGCTGGTCAAA
GAGGGAGTGGTGAAAGATCTCAGTGGAGGCATTGATCGTGAATTTTGAACACAGAAAACCTCA
GTTGAAAATGCAACTCTAACTCTGAGAGCTGTTTTTGACAGCCTTCTTGATGTATTTCTCCAT
CCTGCAGATACTTTGAAGTGCAGCTCATGTTTTTAACTTTTAATTTAAAAACACAAAAAAAAT
TTTAGCTCTTCCCACTTTTTTTTTCCTATTTATTTGAGGTCAGTGTTTGTTTTTGCACACCAT
TTTGTAAATGAAACTTAAGAATTGAATTGGAAAGACTTCTCAAAGAGAATTGTATGTAACGAT
GTTGTATTGATTTTTAAGAAAGTAATTTAATTTGTAAAACTTCTGCTCGTTTACACTGCACAT
TGAATACAGGTAACTAATTGGAAGGAGAGGGGAGGTCACTCTTTTGATGGTGGCCCTGAACCT
CATTCTGGTTCCCTGCTGCGCTGCTTGGTGTGACCCACGGAGGATCCACTCCCAGGATGACGT
GCTCCGTAGCTCTGCTGCTGATACTGGGTCTGCGATGCAGCGGCGTGAGGCCTGGGCTGGTTG
GAGAAGGTCACAACCCTTCTCTGTTGGTCTGCCTTCTGCTGAAAGACTCGAGAACCAACCAGG
GAAGCTGTCCTGGAGGTCCCTGGTCGGAGAGGGACATAGAATCTGTGACCTCTGACAACTGTG
AAGCCACCCTGGGCTACAGAAACCACAGTCTTCCCAGCAATTATTACAATTCTTGAATTCCTT
GGGGATTTTTTACTGCCCTTTCAAAGCACTTAAGTGTTAGATCTAACGTGTTCCAGTGTCTGT
CTGAGGTGACTTAAAAAATCAGAACAAAACTTCTATTATCCAGAGTCATGGGAGAGTACACCC
TTTCCAGGAATAATGTTTTGGGAAACACTGAAATGAAATCTTCCCAGTATTATAAATTGTGTA
TTTAA

FIGURE 508

></usr/seqdb2/sst/DNA/Dnaseqs.min/ss.DNA96897
><subunit 1 of 1, 362 aa, 1 stop
><MW: 41736, pI: 8.80, NX(S/T): 3
MRRPSLLLKDILKCTLLVFGVWILYILKLNYTTEECDMKKMHYVDPDHVKRAQKYAQQVL
QKECRPKFAKTSMALLFEHRYSVDLLPFVQKAPKDSEAESKYDPPFGFRKFSSKVQTLLE
LLPEHDLPEHLKAKTCRRCVVIGSGGILHGLELGHTLNQFDVVIRLNSAPVEGYSEHVGN
KTTIRMTYPEGAPLSDLEYYSNDLFVAVLFKSVDFNWLQAMVKKETLPFWVRLFFWKQVA
EKIPLQPKHFRILNPVIIKETAFDILQYSEPQSRFWGRDKNVPTIGVIAVVLATHLCDEV
SLAGFGYDLNQPRTPLHYFDSQCMAAMNFQTMHNVTTETKFLLKLVKEGVVKDLSGGIDR
EF

Important features of the protein:

Transmembrane domains:
Amino acids 11-27;281-297

N-glycosylation sites:
Amino acids 30-34;180-184;334-338 cAMP- and cGMP-dependent protein kinase phosphorylation sites:
Amino acids 2-6;109-113;223-227

N-myristoylation sites:
Amino acids 146-152;150-156;179-185;191-197

FIGURE 509

GGGCGGACGCAGTGCAGTAAGAGCAGATGGGCGGACCCAAATTTCTTCGGCTTCACGATTTTG
CCGAGGTCTAGCCCTGCATCCAGCCTTGAAACAGGGTGGGGAGGAGGCAGAAAGGGGAGGGAC
TGCACTCCCTCTGAGCGTGCTAGCTCCGACTGCCTGACGGATCACCCTTCCGCTCCAACATGG
CTAGTTCCTCAACGCCGTGACTCAAGCCTGTTGTGCCAGGCAGGGCGCACTCAGCAGCGCAGC
CCCACAGGTGGCGAAGGCTCCGCGAGAGGGTTCCCGCCAGGCTAGACAGTGGAGTGCCGCACA
GCGCGCCTTCCAGCCTCGCAGCCGCCACCCTAGCGGTTCCGACCCGGCGCCAGCAGGCCTGCT
TGGTCGATCTTCGAGCCAAAGATGCGGCGAGGCTGGAAGATGGCTCTGTCTGGGGGGCTGCGG
TGCTGCCGCCGGGTACTGTCCTGGGTGCCAGTGCTCGTTATTGTCCTCGTCGTGCTCTGGTCC
TACTATGCCTACGTCTTTGAACTCTGCCTGGTTATTTACCTCATACTCTACCATGCCATCTTT
GTGTTCTTTACCTGGACCTACTGGAAGTCTATCTTTACACTCCCACAGCAGCCAAACCAGAAG
TTCCACTTGTCCTACACAGACAAGGAGCGCTATGAAAATGAAGAAAGACCTGAGGTCCAGAAG
CAGATGCTTGTTGATATGGCCAAAAAGCTACCGGTTTACACAAGAACTGGAAGTGGAGGTCAG
TTCATCCAAAGGCAGCTAGAGAGGCAGCTCAGCAAGTATCTCAGAAAGGCTAAGTCATATATG
TTCTCAAACTAGCCCTTTTTTTTCCTCCCATCTTCTGAAAACCACTATGGAGATTTTTCTCCA
CATTTTATTTCTAAAAAATTTTAAACACATATCAAAGCTGGAAGAATTGTATAGTAAACAAAC
TGTATACCCCAAACTGGATTCTTCTGCTAACATTTTTCTGTGTTGCTATATCACATATCTATC
CACATATGCATACCTCTATTTATCTTTCGTCAAGCCATCTTATGTTTCTGATGCATTTCAAAG
TAAATAGCTGACATCAGTAAGACATCTACCTAAATATTTTATTCTGTTTTGTTAAAATTTACA
TACAAAAACATGCATAATCTTAAGGGTACCATTCCATGTATTTTGAAAAGTGTACACATCTGT
GTAACTAAACCCCCAATAAAATTGCCATCACCTCAG

FIGURE 510

></usr/seqdb2/sst/DNA/Dnaseqs.min/ss.DNA98564
><subunit 1 of 1, 143 aa, 1 stop
><MW: 17255, pI: 9.99, NX(S/T): 0
MRRGWKMALSGGLRCCRRVLSWVPVLVIVLVVLWSYYAYVFELCLVIYLILYHAIFVFFT
WTYWKSIFTLPQQPNQKFHLSYTDKERYENEERPEVQKQMLVDMAKKLPVYTRTGSGGQF
IQRQLERQLSKYLRKAKSYMFSN

Important features of the protein:

Transmembrane domain:
Amino acids 24-45

N-myristoylation sites:
Amino acids 11-17;12-18

FIGURE 511

CAGCCGGGGCGATGGCGGGGCTCTGGCTGGGGCTCGTGTGGCAGAAGCTGCTGCTGTGGGGCG
CGGCGAGTGCCCTTTCCCTGGCCGGCGCCAGTCTGGTCCTGAGCCTGCTGCAGAGGGTGGCGA
GCTACGCGCGGAAATGGCAGCAGATGCGGCCCATCCCCACGGTGGCCCGCGCCTACCCACTGGTG
GGCCACGCGCTGCTGATGAAGCCGGACGGGCGAGGTAAGGGCCGGCGCTCCTCCTGGAGCGCA
ACGGGGTCCGCAGCCCCGTTCCCACCCTCCGATCAGCCAGGAACCCGCTGCTTGTGGCGCTGG
CCGCAGGAGAGAGGAGCCTGTCACCCTGTGGAGAATGCACTCCCAGTTCTAGTCGTTGCCCCT
TGGCACCCGCCGACACTGCTAGTGCCCCATCCCAAAGTGAGCATTTTCTTTGTGTGTAGCACA
GGATGCGGTATTTCCAAACCCCTGCCCTCGGTCTTTTCCCACCTCACCGCTGCTCAGCTCTCA
AAGCCCTGCCGTTTCCTCCTGCCTTGGCTTGGGAAGCCTTAGGAACAGAAGCTCCCTGGGAGC
ACAGAGCGGTTTTAAACTGGCCAACACCTTAACGCCCAGAGCCGCCCTCCTCTCGCTGCCACT
TTGGAAAATAAGAGACTAGAGATTCACTGGACGCTTCCTCCCGGCATCACAAGACTTGACTGC
TGCTTCAGTTCCCGCTTGACCTTCATACTTTAGCCCTTTAAAGGATGTTACATAATAACAATT
AAGAGACGGCAGGGCCTTCAGGCAGACTTCTTTGGAGGGTGTCAAACGCCTTGTTTATTAAAG
AGTGAATTTTTTAATTAAAATCATGTTTTAAAACAGAGATGGACATTTTATTGATGGAAAAAA
ATCACGTTAAGTTAGAAAGCTCTCAAAAGTACCTGGTATTTACAACTCCCTGTCAGGGAGGGC
GAACTCGATCTCAGAGTTTTATTTTCATCAGGGATTACGTTGAGGTACCCAGAAATGAGAAGA
TTTGCCCAAAATGGCATATTTTAAAATTGGCCCAGACCAGAACCCAGTTTCCTCTGGGATTAT
TTGTTAGTAATCGTTTTACAGGCTGAGCATTAACTAACTCCAAAGCTTGAAGGACTTTTTCTC
ATTTTCACTTGTTTTCTCTAATAAAAATAATGCTGTAATTTCAACTTCACAAGATGAGGCCTC
ATGGAAGAGTGTTTACCAAAATATTAAAAATACTTTGACAGAAAAAAATCAAGCGAACTCTTT
GCCAACCAAATATCATCATGACTGATGTAACAAGTAATCCAACACAGATATGAAAATCACTGG
TAAAAATCATCTCAGTTAATTCTAAAAGCAGAGCTAACCACCCCTTTTGTCCTAAGGCTTTAT
GGTATTAAAAAATAAACTGTACAAAAATATAGATTTTCCCCTATCCCCTACCCCTGGAAAGTA
ATATACTGAAGTCTCATCATACTGTTTTGGGGATTCCAGTAATTAAAATCTCTAGTGAACAAA
GACCTGTTTCAAAACAACCTGTGAGCTGACTGGACTATTTAAAGTAATTCTCCTTGTAGTCAC
TTTCAGAGTGAAGACAATGACGAATACTGTCTTTTACAAAGGGACTTTTTATTCCACCAACAA
ATTCTGGATTTTGGCATCAGGAAAACCACTGTTCAATTTCCAACACTATATCCAAGTTGTTTG
AGAAATTATTTAAAACTCTTTAACTTAGAGGGTTTTCTTTCTCCTTTACTTGTTAAAGTGACT
ATATTACAGAGTCACTTTAAGGATTAAATTTATTGCATGCAAAGTTTCTAGATCACTGTCTAG
AAGTCAGTTAGAGTAAGTTCTTTAGTTGTCAATCAAGCATTTAGTAAGGCCCTGCTTTGTGCC
CAGTGTTGACCTCAACAAAGTTGGGGATATCAGAATATTCTAAGATACAGTCGTTGTTCCCAA
GAATCTTGTCTTTCACATACAAGAGGTGTTGCGTTTCATTTTGCGGCTAATGTCCAAACGCTG
GCCTCAGCCATTTCACCTTGAAGATTGCAGTTGGCTTCCAACTGGCCTCTAAACTCTAATCTA
GCATTTTCCAGTCCATTGTGACAAAGTCTGCCTTCCCCAGCTACTCCCAGCTGTTGGACCTGC
TGCCTTAGAACCACAGATTGGTACCTCGTGCC

FIGURE 512

></usr/seqdb2/sst/DNA/Dnaseqs.min/ss.DNA107443
><subunit 1 of 1, 178 aa, 1 stop
><MW: 19353, pI: 10.97, NX(S/T): 0
MAGLWLGLVWQKLLLWGAASALSLAGASLVLSLLQRVASYARKWQQMRPIPTVARAYPLV
GHALLMKPDGRGKGRRSSWSATGSAAPFPPSDQPGTRCLWRWPQERGACHPVENALPVLV
VAPWHPPTLLVPHPKVSIFFVCSTGCGISKPLPSVFSHLTAAQLSKPCRFLLPWLGKP

Important features of the protein:
Signal peptide:
Amino acids 1-25 cAMP- and cGMP-dependent protein kinase phosphorylation site:
Amino acids 75-79

N-myristoylation sites:
Amino acids 3-9;17-23;145-151

Amidation site:
Amino acids 73-77

Leucine zipper pattern:
Amino acids 8-30

FIGURE 513

GGCGGCTGGACGAGGACGCTCAGAGCCCAGCTCTCGAGAGTTCAAGCAACCGACGGTTCC
CCACTGCTCCCAGGAGCGGTTACCTGGGCACTCTGTGCCCCTCCTTCCTGTTCGGGCCCA
GGCCGAGGACCTGCCAGTAGGGCTCAGTTGCCTGGAGCCCGTTCAGCCCATCCCCCAGTT
CACTTTGCTTGTGGGATCTCCCCGTTGCTCCTGCCCGTGGACTGAGTGGCAGGCCATCCT
ACAAGCACCCGGACACTTGACATCAGTGGTGTCAAGACAACTCTAAGAAGGTTTTCCGTG
ATCCTGCAAGCCCTGCCTTCCTTCCTGGGATCCTGCCTTCAATTTGATTGCACAGGTACC
ACAGCAAGCCAGTGCTGTGTGCTCCGAGTTCCAGGGCGTCCTCCAGCTCAGCCACTGCAC
TGAGAACATGGACTCTCTGTGGGGCCCAGGAGCCGGGAGTCACCCCTTTGGGGTCCACAA
CACCCGGCTGTCCCCAGACTTGTGTCCAGGGAAGATAGTGTTGAGGGCCCTCAAGGAGAG
CGGGGCAGGGATGCCTGAGCAGGACAAGGACCCTAGAGTCCAAGAGAATCCTGGTGATCA
GAGAAGGGTCCCCGAGGTCACCGGGGATGCACGGTCTGCATTTCGGCCCCTGCGGGACAA
TGGAGGCCTCTCTCCCTTTGTGCCCGGGCCCGGGCCTCTGCAGACAGACCTCCATGCCCA
GAGGTCAGAAATCAGATATAACCAGACATCCCAGACCTCCTGGACGAGCTCCTGCACCAA
CCGAAATGCCATCTCCAGCTCCTACAGCTCCACGGGAGGCTTGCTGGGGCTAAAGCGGAG
GAGGGGGCCAGCCTCATCCCACTGCCAGCTGACCCTCAGTTCCTCAAAGACAGTGAGTGA
GGACAGGCCTCAGGCTGTCTCTTCAGGTCACACCCAGTGTGAAAAGGCAGCAGATATAGC
ACCAGGGCAGACACTCACCCTCAGGAATGACTCCTCCACATCCGAGGCCTCTAGGCCCAG
TACACACAAGTTTCCCCTGCTGCCACGCAGGCGAGGGGAGCCTTTGATGCTGCCACCTCC
CTTAGAGCTGGGGTACCGGGTCACTGTTGAAGACCTGGACCGGGAGAAGGAGGCGGCCTT
CCAGCGCATCAACAGTGCACTGCAGGTTGAGGACAAGGCCATCTCGGACTGCAGACCCTC
ACGGCCTTCCCACACTTTGTCCTCACTTGCAACAGGGGCTTCTGGTCTGCCTGCCGTTTC
TAAAGCACCCAGTATGGATGCACAGCAGGAGACACACAAGTCCCAAGACTGCCTGGGCCT
ACTGGACCCCTTAGCATCTGCTGCAGGGGTCCCCTCTACAGCTCCCATGTCTGGGAAGAA
GCACAGACCACCAGGCCCCCTGTTCTCCTCCTCAGATCCCCTTCCTGCCACCTCTTCTGA
TTCCCAGGACTCAGCCCAGGTCACCTCGCTGATTCCTGCCCCCTTCCCAGCTGCAAGCAT
GGATGCGGGCATGAGAAGAACAAGGCATGGCACTTCTGCTCCTGCAGCTGCCGCAGCAGC
CCCTCCCCGCTCCACATTGAACCCCACGTTGGGGTCACTACTGGAGTGGATGGAGGCCCT
TCACATTTCTGGGCCTCAGCCACAGCTGCAGCAGGTGCCCAGAGGTCAGAACCAGAGATC
CCAGACCTCCTGGACCAGCTCGTGCCCCAAATGAAATGCCATCTCGAGCCCCTACAGCTC
TACGGGAGGCCTCCCGGAACAAAAGCGGAAGAGGGGCCAGCCTCATCCCACTGCCAGCTG
ACCCTCAGTTCCTCAAACACAGTGAGTGAGGACGGACCTCAGGCTGTCTCTTCGGGTCAC
ACCCAGTGTGAAAAGACGGCAGATACAGCACCAGGGCAGACACTCGCCTCCAGGGGTGGC
TCCCCCAGATCCCAGGCCTCTAGGCCCCGTATATGCAAGTTTCCCCTGCTGCCACGCAGG
CGAGGGGAGCCTTTGATGCTGCCACCTCCCTTAGAGATGGGGTACCGGGTCACTGCTGAA
GACCTGGACCGGGAGAAGGAGGAGGCATTCCAGCGCATCAACAGTGCACTGCAGGTTGAG
GACCAGGCCATCTAGGACTGCAGACCCTCACGGCCTTCCCACACTTTGTCCTCACTTGCA
ACAGGGGCTTCTGGTCTGCCTGCCGTTTCTAAAGCACCCAGTATGGATGCACAGCAGGAG
ACACACAAGTCCCAAGACTGCCTGGGCCTAGTGGCCCCCCTGCATCTGCTGCACAGGCCT
GTAGTCCCAGCTACTTGGGAGGCTGAGGCAGGAGAACGGCATAAACCCGGGAGGCAGAGC
TTGCAGTGAGCTGAGATCGCGCCACTGCACTCCAGCCTGGGTGACAGAGCGAGACTCCGT
CTC

FIGURE 514

></usr/seqdb2/sst/DNA/Dnaseqs.full/ss.DNA107786
><subunit 1 of 1, 428 aa, 1 stop
><MW: 45450, pI: 9.28, NX(S/T): 3
MDSLWGPGAGSHPFGVHNTRLSPDLCPGKIVLRALKESGAGMPEQDKDPRVQENPGDQRR
VPEVTGDARSAFRPLRDNGGLSPFVPGPGPLQTDLHAQRSEIRYNQTSQTSWTSSCTNRN
AISSSYSSTGGLLGLKRRRGPASSHCQLTLSSSKTVSEDRPQAVSSGHTQCEKAADIAPG
QTLTLRNDSSTSEASRPSTHKFPLLPRRRGEPLMLPPPLELGYRVTVEDLDREKEAAFQR
INSALQVEDKAISDCRPSRPSHTLSSLATGASGLPAVSKAPSMDAQQETHKSQDCLGLLD
PLASAAGVPSTAPMSGKKHRPPGPLFSSSDPLPATSSDSQDSAQVTSLIPAPFPAASMDA
GMRRTRHGTSAPAAAAAAPPRSTLNPTLGSLLEWMEALHISGPQPQLQQVPRGQNQRSQT
SWTSSCPK

Important features of the protein:
N-glycosylation sites:
Amino acids 105-109;187-191

Glycosaminoglycan attachment site:
Amino acids 38-42

N-myristoylation sites:
Amino acids 15-21;130-136;180-186;307-313;361-367

Amidation site:
Amino acids 315-319

Prokaryotic membrane lipoprotein lipid attachment site:
Amino acids 106-117

FIGURE 515

GTCAGGGCCAGGGTGAGCGCCCGACTCCGAGCTGTCCCCGCTCCCGGCGCGGCGCTCCGCTCT
CAGCCACCTCACGGCTGCCAGGAGTGCGCGGGAGTTTGCCCCGGAGCGCGGGGAAGTTTCCTC
CGAAGCTGCGCTCCTGGAACAGCAGCACCTGCAAGCGCCCGGCAGCGGCCCGCGAGGTTACTT
TATGGAATTGGGCTCTTAGAGAACAAGAAAAGACTGAAGTTTTACGGGAAAACAAATCATGTG
GTCTTCAGATTCTGAAATAAGGAGAAATGCAGCCATCTGAAATGGTCATGAACCCCAAACAAG
TCTTCCTCTCTGTGCTGATATTTGGAGTAGCTGGGCTACTCCTCTTCATGTATTTGCAAGTCTGG
ATTGAAGAACAACATACAGGGAGAGTGGAGAAGAGAAGAGAACAAAAAGTAACTTCAGGATGG
GGACCAGTGAAGTACTTGCGGCCTGTACCCAGAATCATGAGTACAGAAAAAAATCCAGGAACAT
ATCACCAACCAGAACCCCAAGTTTCACATGCCTGAGGATGTACGAGAAAAAAAGGAAAATCTT
CTACTCAATTCTGAGAGATCTACTAGGCTCTTAACAAAGACCAGTCATTCACAAGGAGGGGAT
CAAGCTTTAAGTAAGTCCACAGGGTCACCAACAGAGAAGTTGATTGAAAAACGTCAAGGAGCT
AAGACTGTTTTTAACAAGTTCAGCAACATGAATTGGCCAGTGGACATTCACCCTTTAAACAAA
AGTTTAGTCAAAGATAATAAATGGAAGAAAACTGAGGAGACCCAAGAGAAACGAAGGTCTTTC
CTTCAGGAGTTTTGCAAGAAATACGGTGGGGTGAGTCATCATCAGTCACATCTTTTTCATACA
GTATCCAGAATCTATGTAGAAGATAAACACAAAATCTTATATTGTGAGGTACCTAAGGCTGGC
TGTTCCAATTGGAAAAGAATTCTGATGGTACTAAATGGATTGGCTTCCTCTGCATACAACATC
TCCCACAATGCTGTCCACTACGGGAAGCATTTGAAGAAGCTAGATAGCTTTGACCTAAAAGGG
ATATATACCCGCTTAAATACTTACACCAAAGCTGTGTTTGTTCGTGATCCCATGGAAAGATTA
GTATCAGCCTTTAGGGACAAATTTGAACACCCCAATAGTTATTACCATCCAGTATTCGGAAAG
GCAATTATCAAGAAATATCGACCAAATGCCTGTGAAGAAGCATTAATTAATGGATCTGGAGTC
AAGTTCAAAGAGTTTATCCACTACTTGCTGGATTCCCACCGTCCAGTAGGAATGGACATTCAC
TGGGAAAAGGTCAGCAAACTCTGCTATCCGTGTTTGATCAACTATGATTTTGTAGGGAAATTT
GAGACTTTGGAAGAAGATGCCAATTACTTTTTACAGATGATCGGTGCTCCAAAGGAGCTGAAA
TTTCCCAACTTTAAGGATAGGCACTCTTCCGATGAAAGAACCAATGCTCAAGTCGTGAGACAG
TATTTAAAGGATCTGACTAGAACTGAGAGACAATTAATCTATGACTTTTATTACTTGGACTAT
TTAATGTTTAATTATACAACTCCACTTTTGTAGTTTGCATTCATTTTCTAAAACCCTGTATAT
ACTTAATGATGATAAGTTCAAATCAGCTGTAATTTTTCTATAATTCTCTGTATGACAGAAATT
TAACCAAGTGCAGTTGTCTTGATTTAATGTAGATTTTTACCAAATAGTATGACACCAATTGGC
ACAAAGTTATAGGAAAATCACCTACAGGAGATGTAAACAACTTGAGTTGCTCTAAAATGTTTG
GAAAAGAGCTGCTTTTGCATTATGAATTATATTGTTGAAGCAATAACCTAGCCAGCTGTTGCA
TTAGCTAAAGCAGCCTCTTGCAATGGTAGGAAAAAAGGATCTCAAATAGCATGAGTGTATGTC
TATATCCTGAAATTTATTGTCTAAAATGCATGAATATATTTTTAGCAGTCTGTGGCATATTAA
TCAAACTGTTGAATTGTTTTCTTACACCCTGGAAATCTTTCTATCAACTATAATGATAAATCC
ATTTTGAAGTGATATTTTGGACTTAGGCATTTTACTTTAGATTGGAAGGCATTATGTGATTTACA
ATATGAGAATATAGCAGAAAAACCA

FIGURE 516

></usr/seqdb2/sst/DNA/Dnaseqs.min/ss.DNA108682
><subunit 1 of 1, 443 aa, 1 stop
><MW: 52021, pI: 9.63, NX(S/T): 4
MQPSEMVMNPKQVFLSVLIFGVAGLLLFMYLQVWIEEQHTGRVEKRREQKVTSGWGPVKY
LRPVPRIMSTEKIQEHITNQNPKFHMPEDVREKKENLLLNSERSTRLLTKTSHSQGGDQA
LSKSTGSPTEKLIEKRQGAKTVFNKFSNMNWPVDIHPLNKSLVKDNKWKKTEETQEKRRS
FLQEFCKKYGGVSHHQSHLFHTVSRIYVEDKHKILYCEVPKAGCSNWKRILMVLNGLASS
AYNISHNAVHYGKHLKKLDSFDLKGIYTRLNTYTKAVFVRDPMERLVSAFRDKFEHPNSY
YHPVFGKAIIKKYRPNACEEALINGSGVKFKEFIHYLLDSHRPVGMDIHWEKVSKLCYPC
LINYDFVGKFETLEEDANYFLQMIGAPKELKFPNFKDRHSSDERTNAQVVRQYLKDLTRT
ERQLIYDFYYLDYLMFNYTTPLL

Important features of the protein:
Signal peptide:
Amino acids 1-24

N-glycosylation sites:
Amino acids 159-163;243-247;324-328;437-441

Glycosaminoglycan attachment site:
Amino acids 53-57 cAMP- and cGMP-dependent protein kinase phosphorylation site:
Amino acids 177-181

Tyrosine kinase phosphorylation site:
Amino acids 329-337

N-myristoylation sites:
Amino acids 116-122;236-242

FIGURE 517

GGAACTTCCCAGGCACCCTGTGTGGCCGCACTGCTCCCTCTGGCCCAACCATGCCTCTGTCCAGCCACCTGCTGC
CCGCCTTGGTCCTGTTCCTGGCAGGGTCCTCAGGCTGGGCCTGGGTCCCCAACCACTGCAGGAGCCCTGGCCAGG
CCGTGTGCAACTTCGTGTGTGACTGCAGGGACTGCTCAGATGAGGCCCAGTGTGGTTACCACGGGGCCTCGCCCA
CCCTGGGCGCCCCCTTCGCCTGTGACTTCGAGCAGGACCCCTGCGGCTGGCGGGACATTAGTACCTCAGGCTACA
GCTGGCTCCGAGACAGGGCAGGGGCCGCACTGGAGGGTCCTGGGCCTCACTCAGACCACACACTGGGCACCGACT
TGGGCTGGTACATGGCCGTTGGAACCCACCGAGGGAAAGAGGCATCCACCGCAGCCCTGCGCTCGCCAACCCTGC
GAGAGGCAGCCTCCTCTTGCAAGCTGAGGCTCTGGTACCACGCGGCCTCTGGAGATGTGGCTGAACTGCGGGTGG
AGCTGACCCATGGCGCAGAGACCCTGACCCTGTGGCAGAGCACAGGGCCCTGGGGCCCTGGCTGGCAGGAGTTGG
CAGTGACCACAGGCCGCATCCGGGGTGACTTCCGAGTGACCTTCTCTGCCACCCGAAATGCCACCCACAGGGGCG
CTGTGGCTCTAGATGACCTAGAGTTCTGGGACTGTGGTCTGCCCACCCCCCAGGCCAACTGTCCCCCGGGACACC
ACCACTGCCAGAACAAGGTCTGCGTGGAGCCCCAGCAGCTGTGCGACGGGGAAGACAACTGCGGGGACCTGTCTG
ATGAGAACCCACTCACCTGTGGCCGCCACATAGCCACCGACTTTGAGACAGGCCTGGGCCCATGGAACCGCTCGG
AAGGCTGGTCCCGGAACCACCGTGCTGGTGGTCCTGAGCGCCCCTCCTGGCCACGCCGTGACCACAGCCGGAACA
GTGCACAGGGCTCCTTCCTGGTCTCCGTGGCCGAGCCTGGCACCCCTGCTATACTCTCCAGCCCCGAATTCCAAG
CCTCAGGCACCTCCAACTGCTCGCTGGTCTTCTATCAGTACCTGAGTGGGTCTGAGGCTGGCTGCCTCCAGCTGT
TCCTGCAGACTCTGGGGCCCGGCGCCCCCCGGGCCCCCGTCCTGCTGCGGAGGCGCCGAGGGGAGCTGGGGACCG
CCTGGGTCCGAGACCGTGTTGACATCCAGAGCGCCTACCCCTTCCAGATCCTCCTGGCCGGGCAGACAGGCCCGG
GGGGCGTCGTGGGTCTGGACGACCTCATCCTGTCTGACCACTGCAGACCAGTCTCGGAGGTGTCCACCCTGCAGC
CGCTGCCTCCTGGGCCCCGGGCCCCAGCCCCCCAGCCCCTGCCGCCCAGCTCGCGGCTCCAGGATTCCTGCAAGC
AGGGGCATCTTGCCTGCGGGGACCTGTGTGTGCCCCCGGAACAACTGTGTGACTTCGAGGAGCAGTGCGCAGGGG
GCGAGGACGAGCAGGCCTGTGGCACCACAGACTTTGAGTCCCCCGAGGCTGGGGGCTGGGAGGACGCCAGCGTGG
GGCGGCTGCAGTGGCGGCGTGTCTCAGCCCAGGAGAGCCAGGGGTCCAGTGCAGCTGCTGCTGGGCACTTCCTGT
CTCTGCAGCGGGCCTGGGGGCAGCTAGGCGCTGAGGCCCGGGTCCTCACACCCCTCCTTGGCCCTTCTGGCCCCA
GCTGTGAACTCCACCTGGCTTATTATTTACAGAGCCAGCCCCGAGAGGTCTCCTGTAACTTTGAGCGGGACACAT
GCAGCTGGTACCCAGGCCACCTCTCAGACACACACTGGCGCTGGGTGGAGAGCCGCGGCCCTGACCACGACCACA
CCACAGGCCAAGGCCACTTTGTGCTCCTGGACCCCACAGACCCCCTGGCCTGGGGCCACAGTGCCCACCTGCTCT
CCAGGCCCCAGGTGCCAGCAGCACCCACGGAGTGTCTCAGCTTCTGGTACCACCTCCATGGGCCCCAGATTGGGA
CTCTGCGCCTAGCCATGAGACGGGAAGGGGAGGAGACACACCTGTGGTCGCGGTCAGGCACCCAGGGCAACCGCT
GGCACGAGGCCTGGGCCACCCTTTCCCACCAGCCTGGCTCCCATGCCCAGTACCAGCTGCTGTTCGAGGGCCTCC
GGGACGGATACCACGGCACCATGGCGCTGGACGATGTGGCCGTGCGGCCGGGCCCCTGCTGGGCCCCTAATTACT
GCTCCTTTGAGGACTCAGACTGCGGCTTCTCCCCTGGAGGCCAAGGTCTCTGGAGGCGGCAGGCCAATGCCTCGG
GCCATGCTGCCTGGGGCCCCCCAACAGACCATACCACTGAGACAGCCCAAGGGCACTACATGGTGGTGGACACAA
GCCCAGACGCACTACCCCGGGGCCAGACGGCCTCCCTGACCTCCAAGGAGCACAGGCCCCTGGCCCAGCCTGCTT
GTCTGACCTTCTGGTACCACGGGAGCCTCCGCAGCCCAGGCACCCTGCGGGTCTACCTGGAGGAGCGCGGGAGGC
ACCAGGTGCTCAGCCTCAGTGCCCACGGCGGGCTTGCCTGGCGCCTGGGCAGCATGGACGTGCAGGCCGAGCGAG
CCTGGAGGGTGGTGTTTGAGGCAGTGGCCGCAGGCGTGGCACACTCCTACGTGGCTCTGGATGATCTGCTCCTCC
AGGACGGGCCCTGCCCTCAGCCAGGTTCCTGTGATTTTGAGTCTGGCCTGTGTGGCTGGAGCCACCTGGCCGGGC
CCGGCCTGGGCGGATACAGCTGGGACTGGGGCGGGGGAGCCACCCCCTCTCGTTACCCCCAGCCCCCTGTGGACC
ACACCCTGGGCACAGAGGCAGGCCACTTTGCCTTCTTTGAAACTGGCGTGCTGGGCCCCGGGGGCCGGGCCGCCT
GGCTGCGCAGCGAGCCTCTGCCGGCCACCCCAGCCTCCTGCCTCCGCTTCTGGTACCACATGGGTTTTCCTGAGC
ACTTCTACAAGGGGGAGCTGAAGGTACTGCTGCACAGTGCTCAGGGCCAGCTGGCTGTGTGGGGCGCAGGCGGGC
ATCGGCGGCACCAGTGGCTGGAGGCCCAGGTGGAGGTAGCCAGTGCCAAGGAGTTCCAGATCGTGTTTGAAGCCA
CTCTGGGCGGCCAGCCAGCCCTGGGGCCCATTGCCCTGGATGACGTGGAGTATCTGGCTGGGCAGCATTGCCAGC
AGCCTGCCCCCAGCCCGGGGAACACAGCCGCACCCGGGTCTGTGCCAGCTGTGGTTGGCAGTGCCCTCCTATTGC
TCATGCTCCTGGTGCTGCTGGGACTTGGGGGACGGCGCTGGCTGCAGAAGAAGGGGAGCTGCCCCTTCCAGAGCA
ACACAGAGGCCACAGCCCCTGGCTTTGACAACATCCTTTTCAATGCGGATGGTGTCACCCTCCCGGCATCTGTCA
CCAGTGATCCGTAGACCACCCCAGACAAGGCCCCGCTTCCTCACGTGACATCCAGCACTTGGTCAGACCCTAGCC
AGGGACCGGACACCTGCCCCGCCCAGGCTGGGACAGGCTGCAGGTCTCAGGATATGCTGAGGCCTGGGCGTTCCC
TGCCCTGTGCTGACTCTGTTGCTCTGTGAATAAACACCCTGGCCCATGAGGGCCGCCCCAAAAAAAAAAAAAAAA
AAAAAAAAAAAAAA

FIGURE 518

></usr/seqdb2/sst/DNA/Dnaseqs.min/ss.DNA108684
><subunit 1 of 1, 1137 aa, 1 stop
><MW: 122776, pI: 6.00, NX(S/T): 4
MPLSSHLLPALVLFLAGSSGWAWVPNHCRSPGQAVCNFVCDCRDCSDEAQCGYHGASPTL
GAPFACDFEQDPCGWRDISTSGYSWLRDRAGAALEGPGPHSDHTLGTDLGWYMAVGTHRG
KEASTAALRSPTLREAASSCKLRLWYHAASGDVAELRVELTHGAETLTLWQSTGPWGPGW
QELAVTTGRIRGDFRVTFSATRNATHRGAVALDDLEFWDCGLPTPQANCPPGHHHCQNKV
CVEPQQLCDGEDNCGDLSDENPLTCGRHIATDFETGLGPWNRSEGWSRNHRAGGPERPSW
PRRDHSRNSAQGSFLVSVAEPGTPAILSSPEFQASGTSNCSLVFYQYLSGSEAGCLQLFL
QTLGPGAPRAPVLLRRRRGELGTAWVRDRVDIQSAYPFQILLAGQTGPGGVVGLDDLILS
DHCRPVSEVSTLQPLPPGPRAPAPQPLPPSSRLQDSCKQGHLACGDLCVPPEQLCDFEEQ
CAGGEDEQACGTTDFESPEAGGWEDASVGRLQWRRVSAQESQGSSAAAAGHFLSLQRAWG
QLGAEARVLTPLLGPSGPSCELHLAYYLQSQPREVSCNFERDTCSWYPGHLSDTHWRWVE
SRGPDHDHTTGQGHFVLLDPTDPLAWGHSAHLLSRPQVPAAPTECLSFWYHLHGPQIGTL
RLAMRREGEETHLWSRSGTQGNRWHEAWATLSHQPGSHAQYQLLFEGLRDGYHGTMALDD
VAVRPGPCWAPNYCSFEDSDCGFSPGGQGLWRRQANASGHAAWGPPTDHTTETAQGHYMV
VDTSPDALPRGQTASLTSKEHRPLAQPACLTFWYHGSLRSPGTLRVYLEERGRHQVLSLS
AHGGLAWRLGSMDVQAERAWRVVFEAVAAGVAHSYVALDDLLLQDGPCPQPGSCDFESGL
CGWSHLAGPGLGGYSWDWGGGATPSRYPQPPVDHTLGTEAGHFAFFETGVLGPGGRAAWL
RSEPLPATPASCLRFWYHMGFPEHFYKGELKVLLHSAQGQLAVWGAGGHRRHQWLEAQVE
VASAKEFQIVFEATLGGQPALGPIALDDVEYLAGQHCQQPAPSPGNTAAPGSVPAVVGSA
LLLLMLLVLLGLGGRRWLQKKGSCPFQSNTEATAPGFDNILFNADGVTLPASVTSDP

Important features of the protein:
Signal peptide:
Amino acids 1-20

Transmembrane domain:
Amino acids 1075-1092

N-glycosylation sites:
Amino acids 203-207;281-285;339-343;756-760 cAMP- and cGMP-dependent protein kinase phosphorylation sites:
Amino acids 514-518;1100-1104

N-myristoylation sites:
Amino acids 32-38;55-61;61-67;106-112;116-122;336-342;350-356;409-415;
523-529;540-546;678-684;707-713;791-797;870-876;921-927;
937-943;954-960;1036-1042;1071-1077

Amidation site:
Amino acids 1093-1097

Cell attachment sequence:
Amino acids 191-194

FIGURE 519

GCAGGGGAGCTCCGAGTGTCCACAGGAAGGGAACTATCAGCTCCTGGCATCTGTAAGGATGCT
GTCCATGCTGAGGACAATGACCAGACTCTGCTTCCTGTTATTCTTCTCTGTGGCCACCAGTGG
GTGCAGTGCAGCAGCAGCCTCTTCTCTTGAGATGCTCTCGAGGGAATTCGAAACCTGTGCCTT
CTCCTTTTCTTCCCTGCCTAGAAGCTGCAAAGAAATCAAGGAACGCTGCCATAGTGCAGGTGA
TGGCCTGTATTTTCTCCGCACCAAGAATGGTGTTGTCTACCAGACCTTCTGTGACATGACTTC
TGGGGGTGGCGGCTGGACCCTGGTGGCCAGCGTGCACGAGAATGACATGCGTGGGAAGTGCAC
GGTGGGTGATCGCTGGTCCAGTCAGCAGGGCAACAAAGCAGACTACCCAGAGGGGGATGGCAA
CTGGGCCAACTACAACACCTTTGGATCTGCAGAGGCGGCCACGAGCGATGACTACAAGAACCC
TGGCTACTACGACATCCAGGCCAAGGACCTGGGCATCTGGCATGTGCCCAACAAGTCCCCCAT
GCAGCATTGGAGAAACAGCGCCCTGCTGAGGTACCGCACCAACACTGGCTTCCTCCAGAGACT
GGGACATAATCTGTTTGGCATCTACCAGAAATACCCAGTGAAATACAGATCAGGGAAATGTTG
GAATGACAATGGCCCAGCCATACCTGTGGTCTATGACTTTGGTGATGCTAAGAAGACTGCATC
TTATTACTCACCGTATGGTCAACGGGAATTTGTTGCAGGATTCGTTCAGTTCCGGGTGTTTAA
TAACGAGAGAGCAGCCAACGCCCTTTGTGCTGGGATAAAAGTTACTGGCTGTAACACTGAGCA
TCACTGCATCGGTGGAGGAGGGTTCTTCCCACAGGGCAAACCCCGTCAGTGTGGGGACTTCTC
CGCCTTTGACTGGGATGGATATGGAACTCACGTTAAGAGCAGCTGCAGTCGGGAGATAACGGA
GGCGGCTGTACTCTTGTTCTATAGATGAGACAGAGCTCTGCGGTGTCAGGGCGAGAACCCATC
TTCCAACCCCGGCTATTTGGAGACGGAAAAACTGGAATTCTAACAAGGAGGAGAGGAGACTAA
ATCACATCAATTTGCA

FIGURE 520

></usr/seqdb2/sst/DNA/Dnaseqs.min/ss.DNA108701
><subunit 1 of 1, 325 aa, 1 stop
><MW: 36212, pI: 8.68, NX(S/T): 1
MLSMLRTMTRLCFLLFFSVATSGCSAAAASSLEMLSREFETCAFSFSSLPRSCKEIKERC
HSAGDGLYFLRTKNGVVYQTFCDMTSGGGGWTLVASVHENDMRGKCTVGDRWSSQQGNKA
DYPEGDGNWANYNTFGSAEAATSDDYKNPGYYDIQAKDLGIWHVPNKSPMQHWRNSALLR
YRTNTGFLQRLGHNLFGIYQKYPVKYRSGKCWNDNGPAIPVVYDFGDAKKTASYYSPYGQ
REFVAGFVQFRVFNNERAANALCAGIKVTGCNTEHHCIGGGGFFPQGKPRQCGDFSAFDW
DGYGTHVKSSCSREITEAAVLLFYR

Important features of the protein:
Signal peptide:
Amino acids 1-26

Glycosaminoglycan attachment site:
Amino acids 86-90

N-myristoylation sites:
Amino acids 23-29;88-94;127-133;136-142;265-271

FIGURE 521

GATCAGTGTGTGAGGGAACTGCCATCATGAGGTCTGACAAGTCAGCTTTGGTATTTCTGCTCCTGCAGCTCTTCT
GTGTTGGCTGTGGATTCTGTGGGAAAGTCCTGGTGTGGCCCTGTGACATGAGCCATTGGCTTAATGTCAAGGTCA
TTCTAGAAGAGCTCATAGTGAGAGGCCATGAGGTAACAGTATTGACTCACTCAAAGCCTTCGTTAATTGACTACA
GGAAGCCTTCTGCATTGAAATTTGAGGTGGTCCATATGCCACAGGACAGAACAGAAGAAAATGAAATATTTGTTG
ACCTAGCTCTGAATGTCTTGCCAGGCTTATCAACCTGGCAATCAGTTATAAAATTAAATGATTTTTTTGTTGAAA
TAAGAGGAACTTTAAAAATGATGTGTGAGAGCTTTATCTACAATCAGACGCTTATGAAGAAGCTACAGGAAACCA
ACTACGATGTAATGCTTATAGACCCTGTGATTCCCTGTGGAGACCTGATGGCTGAGTTGCTTGCAGTCCCTTTTG
TGCTCACACTTAGAATTTCTGTAGGAGGCAATATGGAGCGAAGCTGTGGGAAACTTCCAGCTCCACTTTCCTATG
TACCTGTGCCTATGACAGGACTAACAGACAGAATGACCTTTCTGGAAAGAGTAAAAAATTCAATGCTTTCAGTTT
TGTTCCACTTCTGGATTCAGGATTACGACTATCATTTTTGGGAAGAGTTTTATAGTAAGGCATTAGGAAGGCCCA
CTACATTATGTGAGACTGTGGGAAAAGCTGAGATATGGCTAATACGAACATATTGGGATTTTGAATTTCCTCAAC
CATACCAACCTAACTTTGAGTTTGTTGGAGGATTGCACTGTAAACCTGCCAAAGCTTTGCCTAAGGAAATGGAAA
ATTTTGTCCAGAGTTCAGGGGAAGATGGTATTGTGGTGTTTTCTCTGGGGTCACTGTTTCAAAATGTTACAGAAG
AAAAGGCTAATATCATTGCTTCAGCCCTTGCCCAGATCCCACAGAAGGTGTTATGGAGGTACAAAGGAAAAAAAC
CATCCACATTAGGAGCCAATACTCGGCTGTATGATTGGATACCCCAGAATGATCTTCTTGGTCATCCCAAAACCA
AAGCTTTTATCACTCATGGTGGAATGAATGGGATCTATGAAGCTATTTACCATGGGGTCCCTATGGTGGGAGTTC
CCATATTTGGTGATCAGCTTGATAACATAGCTCACATGAAGGCCAAAGGAGCAGCTGTAGAAATAAACTTCAAAA
CTATGACAAGCGAAGATTTACTGAGGGCTTTGAGAACAGTCATTACCGATTCCTCTTATAAAGAGAATGCTATGA
GATTATCAAGAATTCACCATGATCAACCTGTAAAGCCCCTAGATCGAGCAGTCTTCTGGATCGAGTTTGTCATGC
GCCACAAAGGAGCCAAGCACCTGCGATCAGCTGCCCATGACCTCACCTGGTTCCAGCACTACTCTATAGATGTGA
TTGGGTTCCTGCTGACCTGTGTGGCAACTGCTATATTCTTGTTCACAAAATGTTTTTTATTTTCCTGTCAAAAAT
TTAATAAAACTAGAAAGATAGAAAAGAGGGAATAGATCTTTCCAAATTCAAGAAAGACCTGATGGGGTAATCCTG
TTAATTCCAGCCACATAGAATTTGGTGAAAACCTTGCTATTTTCATATTATCTATTCTGTTATTTTATCTTAGCT
ATATAGCCTAGAATTCCATGATCATGAGGTTGTGAGTATATCTCATTCTTTCGTTGTATTTTCCTAGGTGTCTTT
ACTCTCTTCTCTCACTTTGTGACACAAGGACATGAATACATCTAAATTTTCCTATTTCTGATATGACTGTTTTGA
TGATGTCATTACTTCTATAACCTTAAGTGATAGGGTGACATGCAATATGATTATTCCTGGTGTGCGCCCAAACAC
ATGGATATAAAGAGGTAAAAAACTTAAAATTCACAAAATTCAGTAAACCACACAAATCAGGTAAGTGTTCTATGA
GATTAGCTGGCTATGAGAAACATAATGATGTTTCTTTTTCAATTTAAATAAGCCTTTCTACATAGCCAGCATCAG
TGATCTCAGAAAATAAATTGCTAATAATGATGACATGGCATTATGCTTAGAAAAGTTTGCTGTATTTCCATAGAC
CTCATCTAGATGTCATGGCCTACATTTCTGCCATCACTCAACCAATACTTTTTTCTGTTTTCTTGATGATAAAAA
GACCTTTCTCATGATTGCCATCAAATAACAAAAGAAACTATTTTTTTTCTCACATAGAGAACATGTCAGTAAGAT
ATTCAAGGTGAACAGATATTTTTGGGATTAGTAACTATTTGAAATATGTGGTGATAATTACTGAGTTTATAAAAT
TTATTTGATAGTACACTTAAAGAAGATTTATATGTTTATTCTTTAAAAATGATGAATACTCATAATTCTTATCTC
TATAATCAAAAGTATAATTTACTGTAGAAAAATAAAGAGATGCTTGTTCTGAAAGTAAGATCAGTGAACTGCTTT
TCAGTCTCAATCTTTGAGAATTGTAAATTCATCAAATAATTGCTTACATAGTAAAAATTTAAGGTATTAGAAAAC
CTGCATAACAAATAGTATTATATATTAAATATTTTGATATGTAAAGCTCTACACAAAGCTAAATATAGTGTAATA
ATGTTTACACTAGTAAGCAAATATGTTAATCTTCTCATTTTTTTACTGTCATATAATCTTAGTGATATGCCTATT
AATAGTTTTAAATAAATAAATTGGCTTATCTGGCTTTTTGAAAATTTTGAAATTCTTACAGATGTTGATTAGGTA
TATCTACAAATTAATTTCAATTTTAAAATGATGATATAAAAATAAATATAAGTATTTTTCTTGTGTATGTATACA
ATAAATATAAATAAAATTGTTTACTGTTTTGAAAGTTTCTTAAGTTTTA

FIGURE 522

></usr/seqdb2/sst/DNA/Dnaseqs.min/ss.DNA108720
><subunit 1 of 1, 527 aa, 1 stop
><MW: 60284, pI: 8.31, NX(S/T): 3
MRSDKSALVFLLLQLFCVGCGFCGKVLVWPCDMSHWLNVKVILEELIVRGHEVTVLTHSK
PSLIDYRKPSALKFEVVHMPQDRTEENEIFVDLALNVLPGLSTWQSVIKLNDFFVEIRGT
LKMMCESFIYNQTLMKKLQETNYDVMLIDPVIPCGDLMAELLAVPFVLTLRISVGGNMER
SCGKLPAPLSYVPVPMTGLTDRMTFLERVKNSMLSVLFHFWIQDYDYHFWEEFYSKALGR
PTTLCETVGKAEIWLIRTYWDFEFPQPYQPNFEFVGGLHCKPAKALPKEMENFVQSSGED
GIVVFSLGSLFQNVTEEKANIIASALAQIPQKVLWRYKGKKPSTLGANTRLYDWIPQNDL
LGHPKTKAFITHGGMNGIYEAIYHGVPMVGVPIFGDQLDNIAHMKAKGAAVEINFKTMTS
EDLLRALRTVITDSSYKENAMRLSRIHHDQPVKPLDRAVFWIEFVMRHKGAKHLRSAAHD
LTWFQHYSIDVIGFLLTCVATAIFLFTKCFLFSCQKFNKTRKIEKRE

Important features of the protein:
Signal peptide:
Amino acids 1-21

Transmembrane domain:
Amino acids 489-510

N-glycosylation sites:
Amino acids 131-135;313-317;518-522 cAMP- and cGMP-dependent protein kinase phosphorylation sites:
Amino acids 67-71;340-344

Tyrosine kinase phosphorylation sites:
Amino acids 122-131;136-144

N-myristoylation sites:
Amino acids 19-25;276-282;373-379;377-383

Amidation site:
Amino acids 338-342

FIGURE 523

GGCTGCGGGGTCGGCACGGAAGATGCACGCGAGGCTCCTGGGGCTCTCGGCCCTGCTGCAGGC
GGCCGAACAGAGCGCGCGCCTTTACACCGTGGCTTACTACTTCACCACAGGACGGCTTCTGTG
GGGGTGGCTGGCCCTTGCTGTCCTCCTGCCCGGGTTCTTGGTCCAGGCCCTGAGCTACCTGTG
GTTCCGAGCAGACGGGCATCCAGGGCATTGCTCCTTGGTGATGCTGCACCTCCTACAGCTTGG
TGTTTGGAAGCGGCACTGGGACGCTGCACTGACCAGTCTGCAGAAGGAACTGGAGGCTCCCCA
CCGAGGCTGGCTGCAGCTGCAGGAGGCCGACCTGTCGGCCCTTCGACTCTTGGAGGCCCTGCT
GCAGACTGGGCCCCACCTGCTGCTTCAGACATATGTTTTTCTAGCCTCAGACTTCACAGATATT
GTGCCAGGGGTGAGCACCCTGTTTTCCTGGTCCTCACTCTCCTGGGCACTGGTGTCCTACACT
CGCTTCATGGGCTTCATGAAGCCAGGCCACCTGGCCATGCCATGGGCCGCCCTCTTCTGCCAG
CAGCTCTGGAGGATGGGCATGTTGGGAACCCGCGTGCTGAGTCTGGTTCTGTTCTACAAAGCC
TACCACTTTTGGGTTTTTGTGGTTGCAGGTGCCCACTGGCTGGTGATGACATTCTGGCTTGTC
GCCCAGCAGAGTGACATCATCGACAGCACCTGCCACTGGAGGCTGTTCAACCTGCTCGTGGGG
GCCGTGTACATCCTCTGCTACCTCAGCTTCTGGGACAGCCCTTCTAGAAATAGGATGGTCACG
TTCTACATGGTCATGCTGTTGGAGAACATCATCCTGTTGCTGTTGGCCACCGACTTTCTCCAG
GGGGCATCGTGGACCAGCCTGCAGACCATAGCTGGGGTCCTGTCTGGATTTCTGATTGGCAGT
GTCTCACTGGTAATTTATTACAGCCTGCTGCATCCAAAATCCACAGACATCTGGCAGGGCTGC
CTAAGGAAGTCCTGTGGCATTGCAGGAGGTGATAAAACAGAGAGAAGAGATTCTCCCCGGGCC
ACAGATCTAGCTGGGAAGAGAACCGAGAGCTCAGGCTCATGCCAAGGGGCAAGTTATGAACCA
ACCATTTTAGGGAAGCCCCCTACCCCTGAGCAGGTCCCCCCAGAGGCTGGGCTGGGGACCCAG
GTTGCTGTGGAGGACTCTTTCCTCAGTCATCACCACTGGCTGTGGGTGAAACTTGCCCTAAAA
ACAGGAAATGTGTCTAAGATCAATGCCGCCTTTGGAGATAACAGTCCTGCCTATTGTCCACCT
GCATGGGGGTTGAGTCAACAGGACTACCTGCAGAGAAAGGCCTTGTCTGCCCAGCAAGAGCTC
CCATCCTCATCCCGTGACCCCTCAACCTTAGAGAACAGCTCTGCGTTTGAAGGTGTCCCTAAA
GCAGAGGCCGACCCATTGGAAACCTCAAGTTACGTATCTTTTGCCAGCGATCAGCAGGATGAA
GCACCTACCCAGAACCCAGCAGCCACGCAGGGGGAGGGCACCCCAAAGGAAGGAGCTGACGCT
GTTTCTGGGACACAGGGGAAGGGGACAGGTGGGCAGCAGAGAGGAGGGGAAGGACAGCAGAGT
TCCACGTTGTACTTCAGCGCCACTGCAGAAGTGGCCACATCCTCACAACAAGAAGGCAGCCCA
GCTACTCTGCAAACGGCCCACTCTGGAAGGAGGCTGGGAAAGAGCAGCCCTGCCCAGCCTGCA
TCGCCCCACCCAGTGGGCTTGGCGCCCTTCCCCGACACCATGGCCGACATTAGCCCCATCCTA
GGCACAGGCCCATGTAGAGGCTTCTGCCCCAGTGCAGGCTTCCCTGGAAGAACCCTCAGTATC
TCAGAGCTAGAGGAGCCGCTGGAGCCCAAAAGGGAGCTAAGTCACCATGCAGCTGTTGGTGTG
TGGGTGTCATTGCCACAGCTGAGGACTGCCCATGAGCCCTGCCTCACGTCCACCCCTAAGTCT
GAGTCTATCCAAACGGACTGCAGCTGCAGGGAACAGATGAAGCAAGAGCCGAGTTTTTTCATC
TGACCACAGTCATGGTGGGATAAGACAACAGGCTGACAAACCAAGCTGGCCATTTGGTACCGT
GAGAAAGGAAATCCCACTTCTGACACCTGTGTCCTTGGGCACATCACTGTCACCTCTGAATCT
CCATCTGCATCCCTGAAAAATGAAGAAACAGGGCTGGATGATTTTGCAGGTCCAATGCAAACA
TCACAGACCCCACCCATGCATAGGAGAGACTCTAACATACTTTAGAGGAGGAGAAAGAGATTC
CAGTCAAAATTGTCTGCTACCTTTTATGAGCTGTAGGTTCCCTTATTTTATCTTTTTGCTGTG
GCTTCTAGGAAACACAAAGGTAAAACCCAGATTCCTATTTTATTTGAGGTTCTTGTTACAATT
AGCTTTGCCTCACATTTAGCGGTTATGAATCTCATTTTAATATATTCTAACTGTATTATGTTA
TGAAATCTCTTGGTAAGATAATTTGCATGCTTTCTGGGAGTAGGTAAGGCCTGTGTGCTTGTA
ATAACTAACATAACTGAAAGTGCAAATGTCA

FIGURE 524

></usr/seqdb2/sst/DNA/Dnaseqs.min/ss.DNA108726
><subunit 1 of 1, 686 aa, 1 stop
><MW: 74981, pI: 6.60, NX(S/T): 2
MHARLLGLSALLQAAEQSARLYTVAYYFTTGRLLWGWLALAVLLPGFLVQALSYLWFRAD
GHPGHCSLVMLHLLQLGVWKRHWDAALTSLQKELEAPHRGWLQLQEADLSALRLLEALLQ
TGPHLLLQTYVFLASDFTDIVPGVSTLFSWSSLSWALVSYTRFMGFMKPGHLAMPWAALF
CQQLWRMGMLGTRVLSLVLFYKAYHFWVFVVAGAHWLVMTFWLVAQQSDIIDSTCHWRLF
NLLVGAVYILCYLSFWDSPSRNRMVTFYMVMLLENIILLLLATDFLQGASWTSLQTIAGV
LSGFLIGSVSLVIYYSLLHPKSTDIWQGCLRKSCGIAGGDKTERRDSPRATDLAGKRTES
SGSCQGASYEPTILGKPPTPEQVPPEAGLGTQVAVEDSFLSHHHWLWVKLALKTGNVSKI
NAAFGDNSPAYCPPAWGLSQQDYLQRKALSAQQELPSSSRDPSTLENSSAFEGVPKAEAD
PLETSSYVSFASDQQDEAPTQNPAATQGEGTPKEGADAVSGTQGKGTGGQQRGGEGQQSS
TLYFSATAEVATSSQQEGSPATLQTAHSGRRLGKSSPAQPASPHPVGLAPFPDTMADISP
ILGTGPCRGFCPSAGFPGRTLSISELEEPLEPKRELSHHAAVGVWVSLPQLRTAHEPCLT
STPKSESIQTDCSCREQMKQEPSFFI

Important features of the protein:
Signal peptide:
Amino acids 1-17

Transmembrane domains:
Amino acids 35-50;269-287;293-313

N-glycosylation sites:
Amino acids 416-420;467-471 cAMP- and cGMP-dependent protein kinase phosphorylation site:
Amino acids 344-348

N-myristoylation sites:
Amino acids 188-194;288-294;299-305;335-341;338-344;362-368;
390-396;473-479;529-535;536-542;558-564;603-609;
643-649

Amidation sites:
Amino acids 354-358;568-572

Leucine zipper pattern:
Amino acids 112-134

FIGURE 525A

AGTGCCCTCTGTCATTTAATCTCCACGGAGTCCTGAAGGTGCTTCCCAGGTTTGTCCCCATCACACAGATGAGGC
AATCGTTCTGTTAAGACTGTCCTTGGGTCATTATGTCAGCAATGAAATCGGTGCTGCCATTACTAAACCCTTACT
GTGTGCTGGCATTTGTGTATGCATGCATGTGTGTGCGTGCACACGTGTGTGTTTGCGTGTACATGTGCATGTGTGTG
TTGTGTGCCTGTGTGTGCACATGTAGAAAGAAAGTGATGTGTGGGAATGGAGAATTCCAACCCAGGAGGAGACTG
TGCCTGGGGCTGCCACGAGAAGTGGTGACACTTCGAGAAACGGGTTCCAAATGCACGTTGCCTTCCAGTTCTCTG
TGTGACCTTGGGCAAGTCACTTCAGCTCCCTGAGCTTTGTTTTTAAAAATATTTTTTAAATGTATAAAACCATGG
ACCATTACATATGAAGAGAAATGTGTGTGCAAACATTCAGTTAATAATCACAAGGTGGAGGAGTGCCTGCTCAGA
CCCAGAGCTGACACAGGGAACTCTCCCAGAAGGCTGCAGGGCTTCCCTCCCAACCCTCCAACGGCCCACTTGCTG
AGCCCGTGCTTATCTGTTCAGTGGAAATGCCATGTGCCACGTTCCTCAGAAGTAAAGCCACTAGGTAAGTGTGAC
ACTCTGTGCCCAGCTTGGTGCAAAGCCCCTTGTGTGTGCTATCTTATTGACCTCCCAAATAGCATGGTAAGGTCA
GTACTGTCACTTCCCCCACTTTGAAGATGAGGAGAGCACAAATTCTAGATGGAAATGGAGGTCACGCAGTGGAAA
TAGGATCCAGACAGATTAATCCAATCTCAAGCCTGAATTCTTCCATTCCACGCTACGCTTGAAGCTCAATCTCTC
TTCCTGGTTGATTCTCCCCACTTCCCCACCCCCAGATATATCCCATCGCTGCTTGGTGGACAGTAGCCATGACTG
GGTTTTGGTAAAGGTTGCTGAATAATCAGGCTGCTGGTTAGTTTTTACATTTCACCTTTCCCAGTGAAATGGGGC
CCCATGAAAAAGGCAGCTCAAGTTGTAAATTACTCAAAGGAAGGACAGAAAGGTCTTCTGTTTGCACCTACCCTA
AGGATTTGGGGTAGACACTGGGAATTTACTAATTATGAATTCCAGTGCTTTCCTTGCTGAAAGAGAGGCGTGGAA
TCAACGCTGAGTGAAGGCATCAAGTTTAAGCTGCTAATTACTTCCTGATCATGCAGAATAAAAGCTACGTCCCTT
GAAATACACCAGGCAGCTAAACATAATCTTTGCGTTTCCGTAGTGTTGGTTAAGGAATCCAGATGTTACTGCAAT
AACCACTCCATAAACAAAAGGAACACCCAGCTGTGAGAACTGGCTTCTCAGCATTCGTCCCAGCAGAGGCTCTTC
CGGGGCCAGCCCTGGAAGAACCCATCAGGGTTCTGATGGTTGCCCTGTTTCAGCACAGCCCTTATTGGCAGGCAG
ACGGCTACGGGCACAGCCACAGGCTGAAGGTGAGTCCAGCACACAACTTTCTGACAGTGAACAGGAGTAAACATG
GGACCCACCCGAAACCTTTGTCTGTTGACTTCTTAGCAAATGGAGGCAGCTCTAGGCTCTGGAGAGTTCGGGTAT
AGGAGACCATGACTTGAGCAGACTGATATAAGTGGAATGCAAACATATTTAGATGGCACAACTTAATTTAGATTT
ATCAGTGCTAATATAGAAAAAGCTAGTATTTATTGGGGCTTATTAGATTTTTAGTCTGAATCCTCACAACTTACG
AGGGGGTTCGTTTTACAGACTATGATCTTGCATGATTTCCCCAAAGATGCTCATTAAGTATATGGTGAAAGTAGA
ATTTGAATACAGAAGACCTGGTTCTGCTACTTTCTGTGTTTCTATTTGGTTCAAACCAGCCTTTCTTCTTTCAAA
ACAACTTCAGTGCAATTCATGGTTTTGGAAAATAAACTTGATTTTGAGATTCAGACAATAAGTGCATTTTTAATG
TTTATTCTTTTATCTTGAAAAACTGATATATTTATGAAATGATATGTGCTCACTCAGTGTCAACACTTCAAACAA
CACAGACAGTACAATGACAAATTGGAGATCAGCTCTAATCTCGGCCCCCAATTTAATGCATTGCTGAATATTCTT
CTGAACATAGTCCATCCCACACTGTCCCATGACACAAGACGCTCCAAGGGGCTGAAGATAGAGGGACTTCTGCAG
TCAAGAGAGCTGGGAAACTCTTGGACAGTCACAATGTGCATTTGGGTATTAAAGGCTCTGCAAAGTTCTGCACCA
AATAAACCCTTGGATTGGCTTGATCCAATGCCATGTTTCCAAAACCTACTTGCCCGTGGGACACCTTAGTCCATA
ACACAGGTTGGCATTTCTTCTAGAGAGTGTGCTGTGAAAAACACTGGTCTCACAGCACCGTGCATTCATCCAGCA
GGTATTTACCAAGCAGGGACTTTGGGCCAGGTCCGTGCTAGGCTCTGCAGGTGGACCAGCCAGCCCTGACCTCCA
TGGTGTCTCTTCTCATGGGAGAGGCTGCACAGCAGTCATTGAGAAAACGAAGAAACACACAGGTACTTTCAGATG
CTGATAATGACTACCATGTGCTAAAAGAGCTCCAGGTGTTGTCTGTTTTGAGACAATCTTCTCGACAATGAGATA
GAATGAACCATGCAAACTTTGGGGGCTACGATGGTTTTAGGAAAGAGCTAGAGTGAAAAATCCTTTGACATATAT
ACATACAAATAAAGATACATGTGTATAATTTTATGTAATTGACATCACATTATATGCTGGCACCTGCCTTTTTTG
CTTAATGAAAATGTCAAAGGTAATATTACCAATCAATCAATATATTTCACCATCGTGTTTAATTTCTGCAGAGCA
CTTATTCAAGCACATACTGCATTTTTCTTAGTCACTCACTGGTGGGAATAGAAAGTTTTCTCAGGCATGCATTTT
TCCCACTTCTGAAATGATCTCCTTAGAATAAATTCCCCAAATTGTATTGCTGGGTTCAAAGGCATGAACATTTTA
CATTTTTATACAATAATGTCAAACTACCTTCCGGAAATGATGCTCACTTTACTTTCCCTCCAAGACTGTGTGAAA
ATGCCCATTTTCCTAAATGCTTACTATGACTGGTTTCCAACTACATTTTAATTCTTGTTCAATCTGATAGGCAAA
AAATGATATTTAATTTTTATTTGATTGATAATGACCTTGAACGTGCCCATTAGCCTTTTGCATGTATTCTTTTAT
GAAACATCTGTTCCTATCCTTCGTCAATGTTCCTCTTCATATGTTAACTTTTCTTATTGATTTGTTAGAGCACTT
TGTATATTGTGAATATTAGCTTTTGTGATCAGAATTATGGAATTGTTGTTGTCTTTAGTTTTGCTTATCAAGTTT
AAAGCCATTCAGAGATGTTGTAAATGTGTATGTTGTTAAATTTATGTCTTATTTTGTGTTTTCTGATGCTCATAT
GTTTAGAATGGTCAAGCAATCCCAACTTATGATTACATAAATATTCTCCCATATTTGCTCTTAGCATTTTTTTC
TTTTCATGTAACCCTTTGTTCTTTCAGGAATTTACTTTGCGGTAAGAAATGGGCTGGCTTCCAGTTTTATGTTTC
CCAAATGGTGATTCAGCTGTTCCATTTCCATATTCTCCCTTATTAGAAATGACCACTATATTATGTTCTAAAATA
TCTGCGTACTTGTGTCCCTTCCTATAATCTCAGTTCATCTCTTTGAGCTATCTTTTGATTCCTTTTTCAAACCAC
ACTGCTTTACTGAACTGTCATCATCTTATACATTTTTAATACTCAGCAAGACAAGTTTCTCAATGCCACTCTTTT
TCAGAGTTTTTCTGGTGGTTGTAAGATGTTTATTCTTCTGGATAAACTTTAGAATCACTCTTTTTGTCCAAGGTA
AAATATATCCCACATTGAGATCATACTGAATATACAGACTAATTCAGGAAAAAATGTATGTCTTTATTGCATTGA
GTCTTCTTATCCAATAAAAAAGATATGAATTTCCATGTATTGAAATCTTCACTGAGACTTATTTTTGGCTTTTCA

FIGURE 525B

CATGTCCTGCAAATGTATTGTTAAATTTATTTTTAGGTATTTTAGGGGAAATGATTTTCTAAAGTTTGTATTTTC
TAGCTTGTTATAATTTACATATGAGATAGTCATTGTTGTATATTATTTATAACTGATCATATTACTGTATTTGTA
TTGTTTTAATAGTTTTTCTATTATTTTGGGTTTTCCTGGAATACAACCTTATTATCTACAAATTATGATTGTTTT
GCCTTTTCCAATGTTCATAACTGTTTTTATATTCTTGTCTGATTGCTTTGTTCAGCACTTCTAGAATAAAGTCAT
GCAATACTAATGA

FIGURE 526

</usr/seqdb2/sst/DNA/Dnaseqs.min/ss.DNA108728
<subunit 1 of 1, 100 aa, 1 stop
<MW: 10922, pI: 8.81, NX(S/T): 0
MSAMKSVLPLLNPYCVLAFVYACMCVRAHVCVCVYMCMCVLCACVCTCRKKVMCGNGEFQ
PRRRLCLGLPREVVTLRETGSKCTLPSSSLCDLGQVTSAP

Important features of the protein:
Signal peptide:
Amino acids 1-28

N-myristoylation sites:
Amino acids 80-86;94-100

Prokaryotic membrane lipoprotein lipid attachment sites:
Amino acids 13-24;34-45

FIGURE 527

GTGAGACTTCTTTCTTCATTGTGGCTAGCTTTGAAAAGACCCTCTGAACTTCCTAAAGATATC
AAGATGATATCACCAGACTTGCCCTTTTTGACAATTGTCTTGATCATAGTTAGTTGGACAACT
TGTGGAGCACTAGCCATACTTCTTTCTTATCTTTACTATGTGTTTAAGGTTGTTCATCTGCAA
GCCAGCTTAACAACTTTTAAGAATAGCCAGCCTGTGAATCCCAAACACTCTAGAAGAAGTGAA
AAGAAATCCAATCATCATAAAGACTCCTCAATACACCATCTTCGTTTATCTGCCAACGATGCT
GAAGATAGCCTTCGCATGCACAGTACTGTGATTAACTTACTAACATGGATTGTATTACTCAGC
ATGCCTTCTCTAATTTATTGGCTAAAGAATCTTAGGTATTATTTTAAACTTAATCCTGATCCA
TGTAAACCTTTGGCATTTATCCTTATTCCGACTATGGCAATTCTTGGAAATACTTACACTGTT
TCAATAAAATCAAGTAAATTGTTGAAGACTACTTCACAATTTCCACTTCCTCTGGCTGTTGGT
GTGATTGCTTTTGGGTCAGCACATTTATATAGGCTTCCATGCTTTGTCTTCATTCCTCTTTTA
CTCCATGCATTATGCAACTTTATGTAAGATTGGACTTAAGGAATGATGAAGATAATTTATGTG
TTTAGGGCCAGTGATAAGAGGGAACACACAGATCCATCAGTATGGACAGCAAGATCCTTTGGA
GAAGACAAGTCTATTTTTACAATATTGAAAATAGGAAATTAGTTTTGTAATGTTTGAGGGAAG
TAGTTGAAGCATGGTTTTGTTTTGTGGTGTGGAATCCATGTACTAATCATTTTTGAAAAATTC
ATGAAGGGATATATGGTGATCACTATCATTGAGGACTCCTGTGCATATAAAATAGTCTGTTTT
ATCAACTGTAAA

FIGURE 528

></usr/seqdb2/sst/DNA/Dnaseqs.min/ss.DNA108738
><subunit 1 of 1, 196 aa, 1 stop
><MW: 22225, pI: 9.90, NX(S/T): 0
MISPDLPFLTIVLIIVSWTTCGALAILLSYLYYVFKVVHLQASLTTFKNSQPVNPKHSRR
SEKKSNHHKDSSIHHLRLSANDAEDSLRMHSTVINLLTWIVLLSMPSLIYWLKNLRYYFK
LNPDPCKPLAFILIPTMAILGNTYTVSIKSSKLLKTTSQFPLPLAVGVIAFGSAHLYRLP
CFVFIPLLLHALCNFM

Important features of the protein:
Signal peptide:
Amino acids 1-25

Transmembrane domains:
Amino acids 91-108;128-143;167-186

N-myristoylation site:
Amino acids 141-147

FIGURE 529

GCGAGCCGGGTCCCACCATGGCCGCGAATTATTCCAGTACCAGTACCCGGAGAGAACATGTCA
AAGTTAAAACCAGCTCCCAGCCAGGCTTCCTGGAACGGCTGAGCGAGACCTCGGGTGGGATGT
TTGTGGGGCTCATGGCCTTCCTGCTCTCCTTCTACCTAATTTTCACCAATGAGGGCCGCGCAT
TGAAGACGGCAACCTCATTGGCTGAGGGGCTCTCGCTTGTGGTGTCTCCCGACAGCATCCACA
GTGTGGCTCCGGAGAATGAAGGAAGGCTGGTGCACATCATTGGCGCCTTACGGACATCCAAGCTT
TTGTCTGATCCAAACTATGGGGTCCATCTTCCGGCTGTGAAACTGCGGAGGCACGTGGAGATG
TACCAATGGGTAGAAACTGAGGAGTCCAGGGAGTACACCGAGGATGGGCAGGTGAAGAAGGAG
ACGAGGTATTCCTACAACACTGAATGGAGGTCAGAAATCATCAACAGCAAAAACTTCGACCGA
GAGATTGGCCACAAAAACCCCAGTGCCATGGCAGTGGAGTCATTCATGGCAACAGCCCCCTTT
GTCCAAATTGGCAGGTTTTTCCTCTCGTCAGGCCTCATCGACAAAGTCGACAACTTCAAGTCC
CTGAGCCTATCCAAGCTGGAGGACCCTCATGTGGACATCATTCGCCGTGGAGACTTTTTCTAC
CACAGCGAAAATCCCAAGTATCCAGAGGTGGGAGACTTGCGTGTCTCCTTTTCCTATGCTGGA
CTGAGCGGCGATGACCCTGACCTGGGCCCAGCTCACGTGGTCACTGTGATTGCCCGGCAGCGG
GGTGACCAGCTAGTCCCATTCTCCACCAAGTCTGGGGATACCTTACTGCTCCTGCACCACGGG
GACTTCTCAGCAGAGGAGGTGTTTCATAGAGAACTAAGGAGCAACTCCATGAAGACCTGGGGC
CTGCGGGCAGCTGGCTGGATGGCCATGTTCATGGGCCTCAACCTTATGACACGGATCCTCTAC
ACCTTGGTGGACTGGTTTCCTGTTTTCCGAGACCTGGTCAACATTGGCCTGAAAGCCTTTGCC
TTCTGTGTGGCCACCTCGCTGACCCTGCTGACCGTGGCGGCTGGCTGGCTCTTCTACCGACCC
CTGTGGGCCCTCCTCATTGCCGGCCTGGCCCTTGTGCCCATCCTTGTTGCTCGGACACGGGTG
CCAGCCAAAAAGTTGGAGTGAAAAGACCCTGGCACCCGCCCGACACCTGCGTGAGCCCTGAGG
CTGGTTGTACAATGCCCACGCCTGCCTGGCTGCTTTCACCTGGGAGTGCTTTCGATGTGGGCA
CCTGGGCTTCCTAGGGCTGCTTCTGAGTGGTTCTTTCACGTGTTGTGTCCATAGCTTTAGTCT
TCCTAAATAAGATCCACCCACACCTAAGTCACAGAATTTCTAAGTTCCCCAACTACTCTCACA
CCCTTTTAAAGATAAAGTATGTTGTAACCAGGACGTCTTAAATGATTCTTTGTGTACCTTTTC
TGTCATATTCAGAAACCGTTCTGTGCCTGCTGGGAGTAATTCCTTTAGCAATTAAGTATTTGG
TAGCTGAATAAGGGGTCAGAACTTCTGAAACCAGAGATCTGTAATCATCTCTATTGGCCTGGG
GTGCCTGTGCTATAAATGAGTTTCTTCACATGAAAAACACAGCCAGCCCAAGATGACTTATCT
GGGTTTAGGATTCAATAGTATTCACTAACTGCTTATTACATGAGCAATTTCATCAAATCTCCA
AACTCTTAAAGGATGCTTTCGGAAAACACGCTGTATACCTAGATGATGACTAAATGCAAAATC
CTTGGGCTTTGGTTTTTTTCTAGTAAGGATTTTAAATAACTGCCGACTTCAAAAGTGTTCTTA
AAACGAAAGATAATGTTAAGAAAAATTTGAAAGCTTTGGAAAACCAAATTTGTAATATCATTG
TATTTTTATTAAAAGTTTTGTAATAAATTTCTAAATTATCA

FIGURE 530

></usr/seqdb2/sst/DNA/Dnaseqs.min/ss.DNA108743
><subunit 1 of 1, 400 aa, 1 stop
><MW: 44876, pI: 8.32, NX(S/T): 2
MAANYSSTSTRREHVKVKTSSQPGFLERLSETSGGMFVGLMAFLLSFYLIFTNEGRALKT
ATSLAEGLSLVVSPDSIHSVAPENEGRLVHIIGALRTSKLLSDPNYGVHLPAVKLRRHVE
MYQWVETEESREYTEDGQVKKETRYSYNTEWRSEIINSKNFDREIGHKNPSAMAVESFMA
TAPFVQIGRFFLSSGLIDKVDNFKSLSLSKLEDPHVDIIRRGDFFYHSENPKYPEVGDLR
VSFSYAGLSGDDPDLGPAHVVTVIARQRGDQLVPFSTKSGDTLLLLHHGDFSAEEVFHRE
LRSNSMKTWGLRAAGWMAMFMGLNLMTRILYTLVDWFPVFRDLVNIGLKAFAFCVATSLT
LLTVAAGWLFYRPLWALLIAGLALVPILVARTRVPAKKLE

Important features of the protein:

Transmembrane domains:
Amino acids 34-53;365-388

N-glycosylation site:
Amino acids 4-8 cAMP- and cGMP-dependent protein kinase phosphorylation site:
Amino acids 140-144

Tyrosine kinase phosphorylation sites:
Amino acids 99-107;220-227

N-myristoylation sites:
Amino acids 35-41;93-99;310-316

Cell attachment sequences:
Amino acids 221-224;268-271

FIGURE 531

AAAAAAAAAAAAAAAAAGAAGCTCTTATGCCAGGAACCTGGAATGGAGACCAAATATATATTG
GTTATATCATAGTATCACAGGGTTACTTTGGCATTTGGGAAACTTGAGAGAAATGGGCAATAA
CTGTTACTTTAAAAGCTTGGGTGCTGTGATTCTGCCTTCAGCCTCAGCCACTTTTGTGGTGCT
TTGCGTGGCATCAGTACCTCCACTGATTCTTCTGTCTTTCCTCTCTCTCTTCCCCCCCTCTTT
CCCTTCTGTTTTTCTCAGATCTAAGGGTTATAATGGAGGGGCAAACTGCCTGGCTATTTCAGA
TAAGACTTCACTGAGTGACTGTTCAGCCCATGATTTACCCTGCAGTTTAACAGGCTCAGGAAT
TAGGTCGCATCAGTTGAGCGCGGGTCACTTAGGCCTATAATCATCATCAGACGGCAATTAAAG
GACCATTTCTGCCTTTTTCACTATTACATCCCCCGCCTGTAGCCCAGCCTGCCATACAGTAGA
TACTCAATAAATATTTGCTGAATGATAACCAATAA

FIGURE 532

</usr/seqdb2/sst/DNA/Dnaseqs.min/ss.DNA108758
<subunit 1 of 1, 100 aa, 1 stop
<MW: 10316, pI: 8.52, NX(S/T): 0
MGNNCYFKSLGAVILPSASATFVVLCVASVPPLILLSFLSLFPPSFPSVFLRSKGYNGGA
NCLAISDKTSLSDCSAHDLPCSLTGSGIRSHQLSAGHLGL

Important features of the protein:
Signal peptide:
Amino acids 1-47

N-myristoylation site:
Amino acids 58-64

FIGURE 533

CGGGGTGTACGAAAGAGAAACCCGGAGGGCGCCGGGGACTGGGCCGGGGTCTGCAGGGCTCAG
CTGAGCCCATGAGCTCCCAGAGCTAACCCCTGAACACCCAGGCGGGCAAAGGGCTGATGTCGG
TAGTCCCCATCCTGGAGGGGCAGGCTCTGCGCATCTGCTCCTGGCATGGCGCTGCGGCACCTC
GCCCTCCTGGCTGGCCTTCTCGTGGGAGTCGCCAGCAAGTCCATGGAGAACACGGCCCAGCTG
CCCGAGTGCTGTGTGGATGTGGTGGGCGTCAACGCCAGCTGCCCAGGCGCAAGTCTGTGTGGT
CCAGGCTGTTACAGGCGCTGGAACGCGGACGGGAGCGCCAGCTGCGTCCGCTGTGGGAACGGA
ACCCTCCCAGCCTACAACGGCTCCGAGTGTAGAAGCTTTGCTGGCCCGGGTGCGCCATTCCCC
ATGAACAGAAGCTCAGGGACCCCCGGGCGGCCACATCCTGGGGCTCCGCGCGTGGCCGCCTCC
CTCTTCCTGGGCACGTTCTTCATTAGCTCCGGCCTCATCCTCTCCGTAGCTGGGTTCTTCTAC
CTCAAGCGCTCCAGTAAACTCCCCAGGGCCTGCTACAGAAGAAACAAAGCTCCGGCCCTGCAG
CCTGGCGAAGCCGCTGCAATGATCCCCCCGCCACAGTCCTCAGACGTGGGGTCTGCAGGAAAG
GAGGACCCACCACGACAGGGCAGACCCCCAATACCTGCTCCTCCTTGAAGTCCAGCTCCACCC
GAGGACAGACGCAGCCGGCCTCCGCCAGGCCCTCCTGAGCAGCCATCGCTTCAGTGGTGCTGG
GTCAGGCGGACCCAAGAGTCAGCCCGTACGGAAGCCGCGCTACGTCAGGCGGGAGCGGCCCCT
GGACAGGGCCACGGATCCCGCTGCCTTCCCGGGGGAGGCCCGTATCAGCAATGTCTGACCTGG
AGGCCGAGACCACGCCACGCACTTGGCGGCAGGGACCCGGAGGCCGACCCCTTGGCGGGAACC
AGCACAAAGTGTTGGCATCGCCCGGCGCCCGGGACAGTCCTGGGCACAGCCTCGGCTCTGGGT
CCCTCCGCCTCCCAGCGACGGACGCCAAAGGGTCCCGGGCCGCCTGAGGCTCCTCCCCACCAC
AGCCATCTCGTTTATCGGACCAGGAGCAGGCATCCATGAGACCTCAGAGCTTCAGATCGAGGC
CTTGGGGGGTCCGGGCCCCCCCAGGAAACACGGTGAGGCCCCAGCGCCTGCAGCCAAAGCTGG
CACGATCTATGGGGCAGGTGCCGCTCTGCCTAGAAAAGCCAGGGGCTCTGCTGCCGTGCCCTC
CAGAGCCCACAGCGGGCAGGACTCCTCCAGCACCACCACACCCAGTGGCCCGAGACCCCTCTG
AGAACAGTGAGGCTGGTCCTCGTGCCGTTCCAGCCGGTGCCCGGCCAGTGGGGAGGACACAGC
CTAGGAACCAGCTGCCTGAGACCAGGGTGCCTCTGGGCTGTCCTCCCGCGTGGCGGAGACCCC
AAGCACGCAGCCACCCATTTCCGGAGCTGCAGGATAGAGCTTCCTCTTGATCTCTGTTTTTAAG
CAGAAATTCATTGTGCAGAAAAGTCCTCCAGAGCTCTGTGGCCCCGCTCGGATCCGCTGGACC
CCCATGCCTGGCTGATCCCTGCCCACGTGGGGCAGGCCCACATCTAACCCCCACAAGTCACTG
CCTCACTGCACCTGCCAAGGCTGCCCTGGCGCTGAGTCCTGGGGTCCCTCCCGGAGTTCCTGG
GAGAAAGGCGCCGTCGTGGCCGCCTCCCGCACGCCAGGCCCGGGCTCCACCGTGGGTCTCAGA
CGCCCTGCGGCACCGGCACCGTCTGCTTTAGCATGGACCCCCATCTGAGGGGTGGCCTGGCC
TTCGGGGTCCCCACGCTCCTTTGCGAAGTCCACTGTGGGTGCCATCATGGTCTCCGGGACCTG
GGCCAGCGGGAACGTGGGGGCACTGGGTGTGCTGATATAAAGTCGGCATTACTCAAAAAAAAA
AAAAAAAAAAAAAAAAAAAAAAAAAAAAAA

FIGURE 534

></usr/seqdb2/sst/DNA/Dnaseqs.min/ss.DNA108765
><subunit 1 of 1, 189 aa, 1 stop
><MW: 19464, pI: 9.60, NX(S/T): 4
MALRHLALLAGLLVGVASKSMENTAQLPECCVDVVGVNASCPGASLCGPGCYRRWNADGS
ASCVRCGNGTLPAYNGSECRSFAGPGAPFPMNRSSGTPGRPHPGAPRVAASLFLGTFFIS
SGLILSVAGFFYLKRSSKLPRACYRRNKAPALQPGEAAAMIPPPQSSDVGSAGKEDPPRQ
GRPPIPAPP

Important features of the protein:
Signal peptide:
Amino acids 1-18

Transmembrane domain:
Amino acids 111-129

N-glycosylation sites:
Amino acids 38-42;68-72;75-79;92-96 cAMP- and cGMP-dependent protein kinase phosphorylation site:
Amino acids 134-138

N-myristoylation sites:
Amino acids 11-17;36-42;43-49;59-65;69-75;122-128

FIGURE 535

TGGATCTGCGGGAATGTGGGCTGGAGAGGTCCTGCCGTGGTACCAGCCTCCAGCCTGCCCCCA
GGACTGCCCCTGACCCAGGCGCGCCCGCTGCTCGGTGGCAGGAGGGCCGGCGGAGCGCCATGG
CCTGCATCCTGAAGAGAAAGTCTGTGATTGCTGTGAGCTTCATAGCAGCGTTCCTTTTCCTGC
TGGTTGTGCGTCTTGTAAATGAAGTGAATTTCCCATTGCTACTAAACTGCTTTGGACAACCTG
GTACAAAGTGGATACCATTCTCCTACACATACAGGCGGCCCCTTCGAACTCACTATGGATACA
TAAATGTGAAGACACAAGAGCCTTTGCAACTGGACTGTGACCTTTGTGCCATAGTGTCAAACT
CAGGTCAGATGGTTGGCCAGAAGGTGGGAAATGAGATAGATCGATCCTCCTGCATTTGGAGAA
TGAACAATGCCCCCACCAAAGGTTATGAAGAAGATGTCGGCCGCATGACCATGATTCGAGTTG
TGTCCCATACCAGCGTTCCTCTTTTGCTAAAAAACCCTGATTATTTTTTCAAGGAAGCGAATA
CTACTATTTATGTTATTTGGGGACCTTTCCGCAATATGAGGAAAGATGGCAATGGCATCGTTT
ACAACATGTTGAAAAAGACAGTTGGTATCTATCCGAATGCCCAAATATACGTGACCACAGAGA
AGCGCATGAGTTACTGTGATGGAGTTTTTAAGAAGGAAACTGGGAAGGACAGTACAGAGTGAC
CATGCAGTGTTGATTGATCGAACAGCAACCACCACATACATGTCCTGCCCCACCACAAAAGGA
AGGAAGGAATAAAAGAAAGAAAGAAAGAAACAAACAAACAAACAAACAAAACTAAGCAAGACA
AAACAAATACCCATGTCAGTGGTTCAAAGATTAAGATTGTGGCTTTGTGTAAAGTTCTTTCCC
TTTGTAGACTTGCTGCATAATTATTCAGGTATGATGGTTACAGTTTTTAAAAAGGAAGGGAAA
TTGTGGTATGTGGTATGTAAATATTTTTAAATGTTGTCTCTCTGTTTTGATCAGTTTTTGTTT
TATTCAATTTGTCTTTATTAAATCTTATCAAAGCA

FIGURE 536

></usr/seqdb2/sst/DNA/Dnaseqs.min/ss.DNA108783
><subunit 1 of 1, 210 aa, 1 stop
><MW: 24022, pI: 9.51, NX(S/T): 1
MACILKRKSVIAVSFIAAFLFLLVVRLVNEVNFPLLLNCFGQPGTKWIPFSYTYRRPLRT
HYGYINVKTQEPLQLDCDLCAIVSNSGQMVGQKVGNEIDRSSCIWRMNNAPTKGYEEDVG
RMTMIRVVSHTSVPLLLKNPDYFFKEANTTIYVIWGPFRNMRKDGNGIVYNMLKKTVGIY
PNAQIYVTTEKRMSYCDGVFKKETGKDSTE

Important features of the protein:
Signal peptide:
Amino acids 1-27

N-glycosylation sites:
Amino acids 148-152 cAMP- and cGMP-dependent protein kinase phosphorylation sites:
Amino acids 6-10;191-195;201-205

N-myristoylation sites:
Amino acids 41-47;87-93;91-97;167-173;178-184

FIGURE 537

GTTTTATTGACAATACATGCATCATATCTTTTGACTTTGAAGGATATCTCATGTCAAAGGAAT
CAAGTTATGATTTATAGAGGATTCAGCTGGAATACCTTGTGGGTGCTGGCTGAGGGTGGCAAA
ACGCCTACCGAGACATGAAGGTTTTAGCCACTAGTTTTGTCCTTGGGAGCCTGGGGTTGGCCT
TCTACCTGCCTTTGGTGGTGACTACACCTAAAACACTGGCCATCCCTGAGAAGCTGCAAGAAG
CTGTGGGGAAAGTTATCATCAATGCCACAACCTGTACTGTCACCTGTGGCCTTGGCTATAAGG
AGGAGACCGTCTGTGAGGTGGGCCCTGATGGAGTGAGAAGGAAATGTCAGACTCAGCGCTTAGAA
TGTCTGACCAACTGGATCTGTGGGATGCTCCATTTCACCATTCTCATTGGCAAGGAATTTGAG
CTTAGCTGTCTGAGTTCAGACATCTTGGAGTTTGGACAGGAAGCTTTCCGGTTCACCTGGAGA
CTTGCTCGAGGTGTCATCTCCACTGACGATGAGGTCTTCAAACCCTTTCAAGCCAACTCCCAC
TTTGTGAAGTTTAAATATGCTCAGGAGTATGACTCTGGGACATATCGCTGTGATGTGCAGCTG
GTAAAAAACTTGAGACTTGTCAAGAGGCTCTATTTTGGGTTGAGGGTCCTTCCTCCTAACTTG
GTGAATCTGAATTTCCATCAGTCACTTACTGAGGATCAGAAGTTAATAGATGAGGGATTGGAA
GTTAATCTGGACAGCTACTCCAAGCCTCACCACCCAAAGTGGAAAAAGAAGGTGGCGTCAGCC
TTGGGAATAGGAATTGCCATTGGAGTGGTTGGTGGCGTGTTGGTGAGGATTGTCCTCTGTGCG
CTAAGGGGGGGCCTGCAGCAGTGACAGCTTCAAGAACTTAACAGCCTTGCTCCTGAAGAACTG
GCTGCCCAGGAAGCCAAGCTAGCTTTTTAGGGGAGTGTTCCAGCTGCTGGTAGTGGATCAGCT
TAGAGGGAACACTCCCACAGCCAAAAGAATGAGTGGGAGAAATGGAGGGGACAATCTCCTGGG
AGCTATGCGCAGTAACCTAACTTCCTTATGTCCCATGGATCTCTTCCTGATCTTCCCTGCCCA
TTGGGTACCCAGGAAACTGCAAGCATTGCCTGTGTTCCTGGGAAGAGTTCTAAGAAGCTTGCA
TTCATTTTCTACCCTTTATGACTTGGATGCCTCCCCACCTCCATTTCCCCTCTTCTGAGCTGT
GTATTCATGTAGAGGGATGTATTCAGCCTTTTTAGTGAACATTTTTTTTCAATAAAAGTAATT
CACAGTAA

FIGURE 538

></usr/seqdb2/sst/DNA/Dnaseqs.min/ss.DNA108789
><subunit 1 of 1, 255 aa, 1 stop
><MW: 28440, pI: 8.92, NX(S/T): 1
MKVLATSFVLGSLGLAFYLPLVVTTPKTLAIPEKLQEAVGKVIINATTCTVTCGLGYKEE
TVCEVGPDGVRRKCQTQRLECLTNWICGMLHFTILIGKEFELSCLSSDILEFGQEAFRFT
WRLARGVISTDDEVFKPFQANSHFVKFKYAQEYDSGTYRCDVQLVKNLRLVKRLYFGLRV
LPPNLVNLNFHQSLTEDQKLIDEGLEVNLDSYSKPHHPKWKKKVASALGIGIAIGVVGGV
LVRIVLCALRGGLQQ

Important features of the protein:
Signal peptide:
Amino acids 1-30

Transmembrane domain:
Amino acids 225-244

N-glycosylation site:
Amino acids 45-49

N-myristoylation sites:
Amino acids 126-132;156-162;204-210;229-235;231-237;235-241

FIGURE 539

GCGCTCATCACTGGCTGGGGACAGAGCCGGGCACCAAGGAGCGACAGGATCCCGAAGAGAGAG
AGAGAAGGCAGCGAGGGAAGGAGGACCCCGGCAGGCAGCAGCATGAAATTCAGCCCAGCGCAC
TACCTGCTGCCTCTCCTGCCTGCGCTGGTCCTCAGCACCAGACAGGACTATGAAGAGCTAGAA
AAGCAGCTGAAAGAAGTCTTTAAGGAGCGAAGCACCATTCTTCGTCAGCTGACAAAGACATCA
AGAGAACTTGATGGAATTAAAGTCAATCTTCAGTCCTTAAAAAACGATGAGCAGTCTGCCAAA
ACTGATGTTCAGAAACTTCTGGAATTAGGACAGAAACAAAGAGAAGAAATGAAGTCTCTTCAG
GAGGCCCTGCAAAATCAGCTTAAGGAGACATCAGAGAAAGCAGAAAAACACCAGGCTACTATT
AATTTTTTAAAGACTGAAGTTGAAAGAAAGAGCAAAATGATCCGAGACCTCCAGAATGAGGAT
TCAAGGAAGAGACCAAGAGATCTCCAGTGGAAGATAGTCTCCATGAGGACCATGTCAATATAC
TTATTGATGTATCTCTAGTACCTAGAATAGTGGAGATTTATATTAGATACAAAATAAATATGT
GTGGAATTAATTAATAA

FIGURE 540

></usr/seqdb2/sst/DNA/Dnaseqs.min/ss.DNA108806
><subunit 1 of 1, 159 aa, 1 stop
><MW: 18865, pI: 9.76, NX(S/T): 0
MKFSPAHYLLPLLPALVLSTRQDYEELEKQLKEVFKERSTILRQLTKTSRELDGIKVNLQ
SLKNDEQSAKTDVQKLLELGQKQREEMKSLQEALQNQLKETSEKAEKHQATINFLKTEVE
RKSKMIRDLQNEDSRKRPRDLQWKIVSMRTMSIYLLMYL

Important features of the protein:
Signal peptide:
Amino acids 1-22

N-myristoylation site:
Amino acids 54-60

FIGURE 541

CTCCACGAGGCTGCCGGCTTAGGACCCCCAGCTCCGACATGTCGCCCTCTGGTCGCCTGTGTC
TTCTCACCATCGTTGGCCTGATTCTCCCCACCAGAGGACAGACGTTGAAAGATACCACGTCCA
GTTCTTCAGCAGACTCAACTATCATGGACATTCAGGTCCCGACACGAGCCCCAGATGCAGTCT
ACACAGAACTCCAGCCCACCTCTCCAACCCCAACCTGGCCTGCTGATGAAACACCACAACCCC
AGACCCAGACCCAGCAACTGGAAGGAACGGATGGGCCTCTAGTGACAGATCCAGAGACACACA
AGAGCACCAAAGCAGCTCATCCCACTGATGACACCACGACGCTCTCTGAGAGACCATCCCCAA
GCACAGACGTCCAGACAGACCCCCAGACCCTCAAGCCATCTGGTTTTCATGAGGATGACCCCT
TCTTCTATGATGAACACACCCTCCGGAAACGGGGGCTGTTGGTCGCAGCTGTGCTGTTCATCA
CAGGCATCATCATCCTCACCAGTGGCAAGTGCAGGCAGCTGTCCCGGTTATGCCGGAATCGTT
GCAGGTGAGTCCATCAGAAACAGGAGCTGACAACCTGCTGGGCACCCGAAGACCAAGCCCCCT
GCCAGCTCACCGTGCCCAGCCTCCTGCATCCCCTCGAAGAGCCTGGCCAGAGAGGGAAGACAC
AGATGATGAAGCTGGAGCCAGGGCTGCCGGTCCGAGTCTCCTACCTCCCCCAACCCTGCCCGCCC
CTGAAGGCTACCTGGCGCCTTGGGGGCTGTCCCTCAAGTTATCTCCTCTGCTAAGACAAAAAG
TAAAGCACTGTGGTCTTTAAAAAAAAAAAAAAAAAAAAAAAAAAAAAAAAAAAAAAAAAAAAA
AAAAAAAAAAAAAAAAAAAAAA

FIGURE 542

></usr/seqdb2/sst/DNA/Dnaseqs.min/ss.DNA108936
><subunit 1 of 1, 178 aa, 1 stop
><MW: 19472, pI: 5.71, NX(S/T): 0
MSPSGRLCLLTIVGLILPTRGQTLKDTTSSSSADSTIMDIQVPTRAPDAVYTELQPTSPT
PTWPADETPQPQTQTQQLEGTDGPLVTDPETHKSTKAAHPTDDTTTLSERPSPSTDVQTD
PQTLKPSGFHEDDPFFYDEHTLRKRGLLVAAVLFITGIIILTSGKCRQLSRLCRNRCR

Important features of the protein:
Signal peptide:
Amino acids 1-21

Transmembrane domain:
Amino acids 147-162

Tyrosine kinase phosphorylation site:
Amino acids 45-52

N-myristoylation site:
Amino acids 146-152

FIGURE 543

CGGCTCGAGGTGAGAAGGAAACTGCAAGAGTGGGGCAGAGAACCAGAGTGTCAGAGCAAAACC
TCCTCTATCTGCACATCCTGGGGACGAACCGGGCAGCCGGAGAGCTGCGGCCGGCCCAGTCCC
GCTCCGCCTTTGAAGGGTAAAACCCAAGGCGGGGCCTTGGTTCTGGCAGAAGGGACGCTATGA
CCGCAGAATTCCTCTCCCTGCTTTGCCTCGGGCTGTGTCTGGGCTACGAAGATGAGAAAAAGA
ATGAGAAACCGCCCAAGCCCTCCCTCCACGCCTGGCCCAGCTCGGTGGTTGAAGCCGAGAGCA
ATGTGACCCTGAAGTGTCAGGCTCATTCCCAGAATGTGACATTTGTGCTGCGCAAGGTGAACG
ACTCTGGGTACAAGCAGGAACAGAGCTCGGCAGAAAACGAAGCTGAATTCCCCTTCACGGACC
TGAAGCCTAAGGATGCTGGGAGGTACTTTTGTGCCTACAAGACAACAGCCTCCCATGAGTGGT
CAGAAAGCAGTGAACACTTGCAGCTGGTGGTCACAGATAAACACGATGAACTTGAAGCTCCCT
CAATGAAAACAGACACCAGAACCATCTTTGTCGCCATCTTCAGCTGCATCTCCATCCTTCTCC
TCTTCCTCTCAGTCTTCATCATCTACAGATGCAGCCAGCACGGTTCATCATCTGAGGAATCCA
CCAAGAGAACCAGCCATTCCAAACTTCCGGAGCARGAGGCTGCCGAGGCAGATTTATCCAATA
TGGAAAGGGTATCTCTCTCGACGGCAGACCCCCAAGGAGTGACCTATGCTGAGCTAAGCACCA
GCGCCCTGTCTGAGGCAGCTTCAGACACCACCCAGGAGCCCCCAGGATCTCATGAATATGCGG
CACTGAAAGTGTAGCAAGAAGACAGCCCTGGCCACTAAAGGAGGGGGGATCGTGCTGGCCAAG
GTTATCGGAAATCTGGAGATGCAGATACTGTGTTTCCTTGCTCTTCGTCCATATCAATAAAAT
TAAGTTTCTCGTCTTA

FIGURE 544

></usr/seqdb2/sst/DNA/Dnaseqs.min/ss.DNA119510
><subunit 1 of 1, 236 aa, 1 stop
><MW: 26079, pI: 5.05, NX(S/T): 3
MTAEFLSLLCLGLCLGYEDEKKNEKPPKPSLHAWPSSVVEAESNVTLKCQAHSQNVTFVL
RKVNDSGYKQEQSSAENEAEFPFTDLKPKDAGRYFCAYKTTASHEWSESSEHLQLVVTDK
HDELEAPSMKTDTRTIFVAIFSCISILLLFLSVFIIYRCSQHGSSSEESTKRTSHSKLPE
QEAAEADLSNMERVSLSTADPQGVTYAELSTSALSEAASDTTQEPPGSHEYAALKV

Important features of the protein:
Signal peptide:
Amino acids 1-16

Transmembrane domain:
Amino acids 135-153

N-glycosylation sites:
Amino acids 44-48;55-59;64-68 cAMP- and cGMP-dependent protein kinase phosphorylation site:
Amino acids 171-175

Tyrosine kinase phosphorylation sites:
Amino acids 61-69;87-95

N-myristoylation sites:
Amino acids 12-18;203-209

FIGURE 545

GGCGGCCCGGAGCTGGGAGCGCGGGGAAGGCGGTTGGGGTTCTGACAGCTGCGCGCGATCCTG
CTCTCTCTCAGCCGCCTGTGGACATGCGCAAAGGGCCCTCTCCTGAGTCCAGATGATGCTCAT
ACCAATGGCTTCAGTGATGGCGGTGACTGAACCGAAATGGGTCTCGGTCTGGAGCCGCTTCCT
CTGGGTGACGCTGCTGAGCATGGTGCTGGGGTCCCTGCTGGCCCTGCTGCTGCCGCTGGGGGC
TGTGGAGGAGCAGTGCTTGGCTGTGCTCAAAGGCCTCTACCTGCTCAGGAGCAAACCGGACAG
GGCGCAGCATGCCGCCACCAAGTGCACCAGCCCGTCCACGGAGCTCAGCATCACCTCCAGGGG
CGCGACGCTGCTGGTGGCCAAGACCAAGGCCTCTCCAGCGGGTAAGTTGGAAGCCAGAGCTGC
CCTGAACCAGGCCCTGGAGATGAAGCGCCAGGGCAAGCGGGAAAAAGCCCAAAAGCTCTTCAT
GCACGCCCTCAAGATGGACCCGGACTTCGTGGACGCGCTCACCGAGTTTGGCATCTTCTCGGA
AGAAGACAAGGACATCATCCAGGCGGACTACTTGTACACCAGAGCATTGACCATCTCACCCTA
CCATGAGAAAGCACTGGTCAACCGCGATCGGACACTGCCTCTTGTGGAAGAGATCGACCAGAG
GTATTTCAGCATCATCGACAGCAAAGTGAAGAAGGTCATGTCCATCCCCAAGGGGAACTCAGC
TCTGCGCAGGGTCATGGAGGAGACCTACTACCATCACATCTACCACACAGTGGCCATCGAGGG
CAACACCCTCACCCTCTCGGAAATCAGGCACATCCTGGAGACCCGCTACGCCGTGCCCGGGAA
GAGCCTGGAGGAGCAGAACGAGGTCATAGGCATGCATGCAGCCATGAAGTACATCAACACGAC
TCTGGTTTCGCGCATCGGCTCCGTCACCATCAGCGACGTGCTGGAGATCCACAGGCGGGTGCT
GGGCTACGTGGACCCCGTGGAAGCCGGCAGGTTTCGGACAACACAGGTCCTGGTCGGACACCA
CATCCCTCCCCATCCGCAGGATGTGGAAAAGCAGATGCAGGAGTTTGTACAGTGGCTCAACTCC
GAGGAAGCCATGAACCTGCACCCAGTGGAGTTTGCAGCCTTAGCCCATTATAAACTCGTTTAC
ATCCACCCTTTCATTGATGGCAACGGGAGGACCTCCCGTCTGCTCATGAACCTCATCCTCATG
CAGGCGGGCTACCCGCCCATCACCATCCGCAAGGAGCAGCGGTCCGACTACTACCACGTGTTG
GAAGCTGCCAACGAGGGCGACGTGAGGCCTTTCATTCGCTTCATCGCCAAGTGTACTGAGACC
ACCCTGGACACCCTGCTTTTTGCCACAACTGAGTACTCGGTGGCACTGCCAGAAGCCCAACCC
AACCACTCTGGGTTCAAGGAGACGCTTCCTGTGAAGCCCTAACCCTAGAAATCCTCAGTGACA
AAGGCTGTCCTGAGGTAGGAAA

FIGURE 546

></usr/seqdb2/sst/DNA/Dnaseqs.min/ss.DNA119517
><subunit 1 of 1, 458 aa, 1 stop
><MW: 51778, pI: 7.81, NX(S/T): 2
MMLIPMASVMAVTEPKWVSVWSRFLWVTLLSMVLGSLLALLLPLGAVEEQCLAVLKGLYL
LRSKPDRAQHAATKCTSPSTELSITSRGATLLVAKTKASPAGKLEARAALNQALEMKRQG
KREKAQKLFMHALKMDPDFVDALTEFGIFSEEDKDIIQADYLYTRALTISPYHEKALVNR
DRTLPLVEEIDQRYFSIIDSKVKKVMSIPKGNSALRRVMEETYYHHIYHTVAIEGNTLTL
SEIRHILETRYAVPGKSLEEQNEVIGMHAAMKYINTTLVSRIGSVTISDVLEIHRRVLGY
VDPVEAGRFRTTQVLVGHHIPPHPQDVEKQMQEFVQWLNSEEAMNLHPVEFAALAHYKLV
YIHPFIDGNGRTSRLLMNLILMQAGYPPITIRKEQRSDYYHVLEAANEGDVRPFIRFIAK
CTETTLDTLLFATTEYSVALPEAQPNHSGFKETLPVKP

Important features of the protein:
Signal peptide:
Amino acids 1-46

N-glycosylation sites:
Amino acids 275-279;446-450

Tyrosine kinase phosphorylation sites:
Amino acids 216-225;217-225;244-232

N-myristoylation sites:
Amino acids 35-41;235-241;266-272;368-374

Amidation site:
Amino acids 119-123

FIGURE 547

CCTCTGTCTGTGCTCCCATCCCAGGGAGTATAGGTGGAGCCTCCAGAGCCCATGGACAGGGCA
TGCTGGGGCTGGGCCAGCCCCAGCGGTGTCTCTAAGGCACCCCTGGGATCCCCACTGAGCTGG
CCTACTTCAGACAGCCAGGGCCCACCCCTCTGGCCCCCTTAGTGTCCAGCTCGTGGCCCCTTG
GCATTTCCACAAGACGCCAAGATGGAGATTCCCATGGGGACCCAGGGCTGCTTCTCAAAGAGC
CTCCTGCTCTCAGCCTCAATCCTGGTCCTCTGGATGCTCCAAGGCTCCCAGGCAGCTCTCTAC
ATCCAGAAGATTCCAGAGCAGCCTCAAAAGAACCAGGACCTTCTCCTGTCAGTCCAGGGTGTC
CCAGACACCTTCCAGGACTTCAACTGGTACCTGGGGGAGGAGACGTACGGAGGCACGAGGCTA
TTTACCTACATCCCTGGGATACAACGGCCTCAGAGGGATGGCAGTGCCATGGGACAGCGAGAC
ATCGTGGGCTTCCCCAATGGTTCCATGCTGCTGCGCCGCGCCCAGCCTACAGACAGTGGCACC
TACCAAGTAGCCATTACCATCAACTCTGAATGGACTATGAAGGCCAAGACTGAGGTCCAGGTA
GCTGAAAAGAATAAGGAGCTGCCCAGTACACACCTGCCCACCAACGCTGGGATCCTGGCGGCC
ACCATCATTGGATCTCTTGCTGCCGGGGCCCTTCTCATCAGCTGCATTGCCTATCTCCTGGTG
ACAAGGAACTGGAGGGGCCAGAGCCACAGACTGCCTGCTCCGAGGGGCCAGGGATCTCTGTCC
ATCTTGTGCTCGGCTGTATCCCCAGTGCCTTCAGTGACGCCCAGCACATGGATGGCGACCACA
GAGAAGCCAGAATTGGGCCCTGCTCATGATGCTGGTGACAACAACATCTATGAAGTGATGCCC
TCTCCAGTCCTCCTGGTGTCCCCCATCAGTGACACAAGGTCCATAAACCCAGCCCGGCCCCTG
CCCACACCCCCACACCTGCAGGCGGAGCCAGAGAACCACCAGTACCAGCAGGACCTGCTAAAC
CCCGACCCTGCCCCCTACTGCCAGCTGGTGCCAACTTCCTGATGGGTCCTGGGCCAGGCCAGC
CAGGGAGAAGACAAGGCCCCAGCCCTCCTCTGGGAGCCTCACACCTGAGACCAGCAGGACAAG
GCCATTGGGGGCTGTGGGGCCGATGAGGTGGACTCAGCCAAAGACTCAGCAGCACATGGGGCA
GGTGTCCTGGCAGGGGGACAGGAGACTGTAACAGGCCCAGGTCCTTGTGCAGCCCCTGAATGC
ACGCCCGCCTTCGGTCTGTTCCTTCAAGCAAGCTGGCCTGGGCCATGTGCCTGTGAAAGGCAG
GCTCTGGCCCCTTTCCATGCCAAAGTCCCCCAAGATCTGGATATCTGGGGACAAGATGGTGGC
CTCAGGCCTGCCTCCCAGGCAGTTGGCTGGGCTCCCAACTGTCTGTCCTCAATGCCCTACCCC
AACTCCACTAGTGACCCTCAGAGTCTTCTCCCCTTAGGACAAGGCAGACACCCCACCATGCGG
GCCTCAGGTGGCAGAGAGGCCCAGCCTCACAGGCCTGTGGCCCCACACACCAGTCCCAGCAAG
GTGACCACGGCTGCTGGACCCCTTCCCTGTTCAGGCAGGCCCAGCCCCTCTCAGAACCTGCTG
CCAGCTGCTGGTCTTGGCCCCCACCCTGAATCTTACTGAGTCCCTCTGGGCAGCAGCTCCCTT
CTCCACCCCACCCCAGCACCCGTCCCAAATGTGGCCTCAGCTTGTCCTCCCCTTCCCCAAACT
ATGCATTCATTCAGCAATAAATGAGCCTTTGCTGCA

FIGURE 548

></usr/seqdb2/sst/DNA/Dnaseqs.min/ss.DNA119535
><subunit 1 of 1, 300 aa, 1 stop
><MW: 32638, pI: 6.02, NX(S/T): 1
MEIPMGTQGCFSKSLLLSASILVLWMLQGSQAALYIQKIPEQPQKNQDLLLSVQGVPDTF
QDFNWYLGEETYGGTRLFTYIPGIQRPQRDGSAMGQRDIVGFPNGSMLLRRAQPTDSGTY
QVAITINSEWTMKAKTEVQVAEKNKELPSTHLPTNAGILAATIIGSLAAGALLISCIAYL
LVTRNWRGQSHRLPAPRGQGSLSILCSAVSPVPSVTPSTWMATTEKPELGPAHDAGDNNI
YEVMPSPVLLVSPISDTRSINPARPLPTPPHLQAEPENHQYQQDLLNPDPAPYCQLVPTS

Important features of the protein:
Signal peptide:
Amino acids 1-32

Transmembrane domain:
Amino acids 159-178

N-glycosylation site:
Amino acids 104-108

N-myristoylation sites:
Amino acids 6-12;29-35;55-61;91-97;157-163;165-171

FIGURE 549

GCCACTCACACCATCTGCTAATGGGACAGCTCACTCTTCCCTCCAAACCATGGCCTTGGCTCA
AGAGCTTCCTTGTTTCTGGAATGTTCTTTCCTCCAGCTCCAGGTGTTGAAATTCTGCCTGGTC
TGGGTCTCCTGTTGAAGGACGCCCTCCACTGGGAAGGATCCTCTTGCCTTCACCACTTGTCTT
CACCAGCCCCTGCTCCCCTCTTCCTCTTGGGGCTGTTGTCGTTGTTGATACTTTTTTTTTGTT
GTGTTTGACACACATCTTCTTCTCACCCTCTAACACAGTTCTCAACCACAGCACTTTTGTCCC
TGGAGATGTTGGCAGTGTCCAGAGGCGTGTTGATGGTCCCACTGGGGTTGGGGGTGCTGCTGGCA
CCAGATGGTAGGGAGATGCCAGGGGTGCTGCTCCACACCCTATGGGACACTGCACAGTACACC
TGGCCTGTGTCCCCCACAGCGAGAGCTGGCCCTGGGCAGGCGTGGTCCCTGCGGTGTGTGTTG
GTTGGGATCCTCCACAGTGACAGACGGTGCGCTCTGCCCACGTTTCCACACAGCTCTTTTGCT
TGTGGAGCTCACCCCTTTGCAGAGAGCTCATTTCCCTGCGGTCTTTGGCCTGCAGAAGTAAAA
TGAGGGGTGGTGAATTACACCCCTGCTGGTTACACATGGAAAACTCAGGAGTGAGAATTTTGT
GGAGAGCAAGAGAGGTGAGACTGGGGTGCTGGCTGCCAGCCAGGCGGTCCCTCAGCCCCTGGA
GAAGCGGGGTGGGGCCTGCACACCGAGTCCTTCCAGTGAGTCCAGTGATGCTCTCTCCTCTTC
CTCCCAGTCACCTTTCTCTCCAGTGCCACTACTGCGCTTTCGATGCAGAATAATTCAGTATTT
GGCGACTTGAAGTCGGACGAGATGGAGCTGCTCTACTCAGCCTACGGAGATGAGACAGGCGTG
CAGTGTGCGCTGAGCCTGCAGGAGTTTGTGAAGGATGCTGGGAGCTACAGCAAGAAAGTGGTG
GACGACCTCCTGGACCAGATCACAGGCGGAGACCACTCTAGGACGCTCTTCCAGCTGAAGCAG
AGAAGAAATGTTCCCATGAAGCCTCCAGATGAAGCCAAGGTTGGGGACACCCTAGGAGACAGC
AGCAGCTCTGTTCTGGAGTTCATGTCGATGAAGTCCTATCCCGACGTTTCTGTGGATATCTCC
ATGCTCAGCTCTCTGGGGAAGGTGAAGAAGGAGCTGGACCCTGACGACAGCCATTTGAACTTG
GATGAGACGACGAAGCTCCTGCAGGACCTGCACGAAGCACAGGCGGAGCGCGGCGGCTCTCGG
CCGTCGTCCAACCTCAGCTCCCTGTCCAACGCCTCCGAGAGGGACCAGCACCACCTGGGAAGC
CCTTCTCGCCTGAGTGTCGGGGAGCAGCCAGACGTCACCCACGACCCCTATGAGTTTCTTCAG
TCTCCAGAGCCTGCGGCCTCTGCCAAGACCTAACTCTAGACCACCTTCAGCTCTTTTATTTTA
TTTTTTTAGTTTTATTTTGCACGTGTAGAGTTTTTGTCATCAGACAAGGACTTTGATCCTGTC
CCCTTTGGCATGCGGGAAGCAGCCGCGGGGAGGTAATGAATTGTCTGTGGTATCATGTCAGCA
GAGTCTCCAAGCCCCACGAACCCTGAGGAGTGGAGTCATACGCGAAGGCCATATGGCCATCGT
GTCAGCAGAGAGAGTCTCTGTACACAGCCCCGTGAACCCTGAGGAGTGGAGTCATACACGAAG
GGCGTGTGGCCATCGTGTCAGCAGAGAGAGTCTCTGTACACAGCCCCGTGAACCCTGAGGAGTGG
AGTCATACGCGAAGGGTGTGTGGCCAGGCTGCAGAGCTGCGTGCCGTTTGTGTCCGAGCATCA
CGTGTGGCTCCAGCCCTTGTTTCTGCCAGTGTAGACACCTCTGTCTGCCCCACTGTCCTGGGG
TCGCTCTTGGGAGGCACAGGCATGGGTGTGTCTGGCCTCATTCTGTATCAGTCCAGTGTGTTC
CTGTCATAGTTTGTGTCTCCCAGGCAGGCCATGGTAGGGGCCTCGCAGGGGCCATTGGGGAGC
ACAGGGCCAGGCTGGGGTGAGGAGAGCTCCCCTGTTTTCTGTTTAATTGATGAGCCTGGGAAA
GGAGTGTGTTCTGCCTGCCCGTTACAGTGGAGCGTTCCGTGTCCATAAAACGTTTTCTAACTG
GGAA

FIGURE 550

></usr/seqdb2/sst/DNA/Dnaseqs.min/ss.DNA119537
><subunit 1 of 1, 104 aa, 1 stop
><MW: 11136, pI: 8.20, NX(S/T): 0
MLAVSRGVLMVPLGLGVLLAPDGREMPGVLLHTLWDTAQYTWPVSPTARAGPGQAWSLRC
VLVGILHSDRRCALPTFPHSSFACGAHPFAESSFPCGLWPAEVK

Important features of the protein:
Signal peptide:
Amino acids 1-20

N-myristoylation sites:
Amino acids 53-59;64-70;97-103

Prokaryotic membrane lipoprotein lipid attachment site:
Amino acids 74-85

FIGURE 551

CGCCCTTAGCATGGGTTTCTGCCGCAGCGCCCTGCACCCGCTGTCTCTCCTGGTGCAGGCCATCATGCTGGCCAT
GACCCTGGCCCTGGGTACCTTGCCTGCCTTCCTACCCTGTGAGCTCCAGCCCCACGGCCTGGTGAACTGCAACTG
GCTGTTCCTGAAGTCTGTGCCCCACTTCTCCATGGCAGCACCCCGTGGCAATGTCACCAGCCTTTCCTTGTCCTC
CAACCGCATCCACCACCTCCATGATTCTGACTTTGCCCACCTGCCCAGCCTGCGGCATCTCAACCTCAAGTGGAA
CTGCCCGCCGGTTGGCCTCAGCCCCATGCACTTCCCCTGCCACATGACCATCGAGCCCAGCACCTTCTTGGCTGT
GCCCACCCTGGAAGAGCTAAACCTGAGCTACAACAACATCATGACTGTGCCTGCGCTGCCCAAATCCCTCATATC
CCTGTCCCTCAGCCATACCAACATCCTGATGCTAGACTCTGCCAGCCTCGCCGGCCTGCATGCCCTGCGCTTCCT
ATTCATGGACGGCAACTGTTATTACAAGAACCCCTGCAGGCAGGCACTGGAGGTGGCCCCGGGTGCCCTCCTTGG
CCTGGGCAGCCTCACCCACCTGTCACTCAAGTACAACAACCTCACTGTGGTGCCCCGCAACCTGCCTTCCAGCCT
GGAGTATCTGCTGTTGTCCTACAACCGCATCGTCAAACTGGCGCCTGAGGACCTGGCCAATCTGACCGCCCTGCG
TGTGCTCGATGTGGGCGGAAATTGCCGCCGCTGCGACCACGCTCCCAACCCCTGCATGGAGTGCCCTCGTCACTT
CCCCCAGCTACATCCCGATACCTTCAGCCACCTGAGCCGTCTTGAAGGCCTGGTGTTGAAGGACAGTTCTCTCTC
CTGGCTGAATGCCAGTTGGTTCCGTGGGCTGGGAAACCTCCGAGTGCTGGACCTGAGTGAGAACTTCCTCTACAA
ATGCATCACTAAAACCAAGGCCCTCCAGGGCCTAACACAGCTGCGCAAGCTTAACCTGTCCTTCAATTACCAAAA
GAGGGTGTCCTTTGCCCACCTGTCTCTGGCCCCTTCCTTCGGGAGCCTGGTCGCCCTGAAGGAGCTGGACATGCA
CGGCATCTTCTTCCGCTCACTCGATGAGACCACGCTCCGGCCACTGGCCCGCCTGCCCATGCTCCAGACTCTGCG
TCTGCAGATGAACTTCATCAACCAGGCCCAGCTCGGCATCTTCAGGGCCTTCCCTGGCCTGCGCTACGTGGACCT
GTCGGACAACCGCATCAGCGGAGCTTCGGAGCTGACAGCCACCATGGGGGAGGCAGATGGAGGGGAGAAGGTCTG
GCTGCAGCCTGGGGACCTTGCTCCGGCCCCAGTGGACACTCCCAGCTCTGAAGACTTCAGGCCCAACTGCAGCAC
CCTCAACTTCACCTTGGATCTGTCACGGAACAACCTGGTGACCGTGCAGCCGGAGATGTTTGCCCAGCTCTCGCA
CCTGCAGTGCCTGCGCCTGAGCCACAACTGCATCTCGCAGGCAGTCAATGGCTCCCAGTTCCTGCCGCTGACCGG
TCTGCAGGTGCTAGACCTGTCCCACAATAAGCTGGACCTCTACCACGAGCACTCATTCACGGAGCTACCACGACT
GGAGGCCCTGGACCTCAGCTACAACAGCCAGCCCTTTGGCATGCAGGGCGTGGGCCACAACTTCAGCTTCGTGGC
TCACCTGCGCACCCTGCGCCACCTCAGCCTGGCCCACAACAACATCCACAGCCAAGTGTCCCAGCAGCTCTGCAG
TACGTCGCTGCGGGCCCTGGACTTCAGCGGCAATGCACTGGGCCATATGTGGGCCGAGGGAGACCTCTATCTGCA
CTTCTTCCAAGGCCTGAGCGGTTTGATCTGGCTGGACTTGTCCCAGAACCGCCTGCACACCCTCCTGCCCCAAAC
CCTGCGCAACCTCCCCAAGAGCCTACAGGTGCTGCGTCTCCGTGACAATTACCTGGCCTTCTTTAAGTGGTGGAG
CCTCCACTTCCTGCCCAAACTGGAAGTCCTCGACCTGGCAGGAAACCAGCTGAAGGCCCTGACCAATGGCAGCCT
GCCTGCTGGCACCCGGCTCCGGAGGCTGGATGTCAGCTGCAACAGCATCAGCTTCGTGGCCCCCGGCTTCTTTTC
CAAGGCCAAGGAGCTGCGAGAGCTCAACCTTAGCGCCAACGCCCTCAAGACAGTGGACCACTCCTGGTTTGGGCC
CCTGGCGAGTGCCCTGCAAATACTAGATGTAAGCGCCAACCCTCTGCACTGCGCCTGTGGGGCGGCCTTTATGGA
CTTCCTGCTGGAGGTGCAGGCTGCCGTGCCCGGTCTGCCCAGCCGGGTGAAGTGTGGCAGTCCGGGCCAGCTCCA
GGGCCTCAGCATCTTTGCACAGGACCTGCGCCTCTGCCTGGATGAGGCCCTCTCCTGGGACTGTTTCGCCCTCTC
GCTGCTGGCTGTGGCTCTGGGCCTGGGTGTGCCCATGCTGCATCACCTCTGTGGCTGGGACCTCTGGTACTGCTT
CCACCTGTGCCTGGCCTGGCTTCCCTGGCGGGGGCGGCAAAGTGGGCGAGATGAGGATGCCCTGCCCTACGATGC
CTTCGTGGTCTTCGACAAAACGCAGAGCGCAGTGGCAGACTGGGTGTACAACGAGCTTCGGGGGCAGCTGGAGGA
GTGCCGTGGGCGCTGGGCACTCCGCCTGTGCCTGGAGGAACGCGACTGGCTGCCTGGCAAAACCCTCTTTGAGAA
CCTGTGGGCCTCGGTCTATGGCAGCCGCAAGACGCTGTTTGTGCTGGCCCACACGGACCGGGTCAGTGGTCTCTT
GCGCGCCAGCTTCCTGCTGGCCCAGCAGCGCCTGCTGGAGGACCGCAAGGACGTCGTGGTGCTGGTGATCCTGAG
CCCTGACGGCCGCCGCTCCCGCTACGTGCGGCTGCGCCAGCGCCTCTGCCGCCAGAGTGTCCTCCTCTGGCCCCA
CCAGCCCAGTGGTCAGCGCAGCTTCTGGGCCCAGCTGGGCATGGCCCTGACCAGGGACAACCACCACTTCTATAA
CCGGAACTTCTGCCAGGGACCCACGGCCGAATAGCCGTGAGCCGGAATCCTGCACGGTGCCACCTC

FIGURE 552

></usr/seqdb2/sst/DNA/Dnaseqs.min/ss.DNA119714
><subunit 1 of 1, 1032 aa, 1 stop
><MW: 115799, pI: 8.61, NX(S/T): 12
MGFCRSALHPLSLLVQAIMLAMTLALGTLPAFLPCELQPHGLVNCNWLFLKSVPHFSMAA
PRGNVTSLSLSSNRIHHLHDSDFAHLPSLRHLNLKWNCPPVGLSPMHFPCHMTIEPSTFL
AVPTLEELNLSYNNIMTVPALPKSLISLSLSHTNILMLDSASLAGLHALRFLFMDGNCYY
KNPCRQALEVAPGALLGLGSLTHLSLKYNNLTVVPRNLPSSLEYLLLSYNRIVKLAPEDL
ANLTALRVLDVGGNCRRCDHAPNPCMECPRHFPQLHPDTFSHLSRLEGLVLKDSSLSWLN
ASWFRGLGNLRVLDLSENFLYKCITKTKALQGLTQLRKLNLSFNYQKRVSFAHLSLAPSF
GSLVALKELDMHGIFFRSLDETTLRPLARLPMLQTLRLQMNFINQAQLGIFRAFPGLRYV
DLSDNRISGASELTATMGEADGGEKVWLQPGDLAPAPVDTPSSEDFRPNCSTLNFTLDLS
RNNLVTVQPEMFAQLSHLQCLRLSHNCISQAVNGSQFLPLTGLQVLDLSHNKLDLYHEHS
FTELPRLEALDLSYNSQPFGMQGVGHNFSFVAHLRTLRHLSLAHNNIHSQVSQQLCSTSL
RALDFSGNALGHMWAEGDLYLHFFQGLSGLIWLDLSQNRLHTLLPQTLRNLPKSLQVLRL
RDNYLAFFKWWSLHFLPKLEVLDLAGNQLKALTNGSLPAGTRLRRLDVSCNSISFVAPGF
FSKAKELRELNLSANALKTVDHSWFGPLASALQILDVSANPLHCACGAAFMDFLLEVQAA
VPGLPSRVKCGSPGQLQGLSIFAQDLRLCLDEALSWDCFALSLLAVALGLGVPMLHHLCG
WDLWYCFHLCLAWLPWRGRQSGRDEDALPYDAFVVFDKTQSAVADWVYNELRGQLEECRG
RWALRLCLEERDWLPGKTLFENLWASVYGSRKTLFVLAHTDRVSGLLRASFLLAQQRLLE
DRKDVVVLVILSPDGRRSRYVRLRQRLCRQSVLLWPHQPSGQRSFWAQLGMALTRDNHHF
YNRNFCQGPTAE

Important features of the protein:

Signal peptide:
Amino acids 1-30

Transmembrane domain:
Amino acids 818-835

N-glycosylation sites:
Amino acids 64-68;129-133;210-214;242-246;300-304;340-344;
469-473;474-477;513-517;567-571;694-698;731-735 cAMP- and cGMP-dependent protein kinase phosphorylation site:
Amino acids 347-351

Tyrosine kinase phosphorylation site:
Amino acids 863-871

N-myristoylation sites:
Amino acids 27-33;41-47;63-69;193-199;361-367;409-415;
563-569;607-613;695-701;794-800;929-935;945-951;
1010-1016

Amidation site:
Amino Acids 974-978

Leucine zipper patterns:
Amino acids 204-226;644-666;814-836

FIGURE 553

GGCGTGGGACGTGCTGCGGCGTCCTAGCTGGCTTACAGGGCGGCGGCGGGGTGTGTGTCCTCT
GTTAAGAGTGCTACTCGCCCGGGGTTGATCTGTGCATGCCACTCCTGGGTCAGACGGTGAGGT
CGGCGTCTGCGAGGACGCGGCGGTGGAGTAGAAGGGCAGCCGGAGACAGGCCCGGCGCCCCTT
CCGAGGCTAGACGGCCCCAGCTTCGCGGGGATCATGGCATTGCTGGTGGACCGAGTGCGGGGC
CACTGGCGAATCGCCGCCGGGCTCCTGTTCAACCTGCTGGTGTCCATCTGCATTGTGTTCCTC
AACAAATGGATTTATGTGTACCACGGCTTCCCCAACATGAGCCTGACCCTGGTGCACTTCGTG
GTCACCTGGCTGGGCTTGTATATCTGCCAGAAGCTGGACATCTTTGCCCCCAAAAGTCTGCCG
CCCTCCAGGCTCCTCCTCCTGGCCCTCAGCTTCTGTGGCTTTGTGGTCTTCACTAACCTTTCT
CTGCAGAACAACACCATAGGCACCTATCAGCTGGCCAAGGCCATGACCACGCCGGTGATCATA
GCCATCCAGACCTTCTGCTACCAGAAAACCTTCTCCACCAGAATCCAGCTCACGCTGATTCCT
ATAACTTTAGGTGTAATCCTAAATTCTTATTACGATGTGAAGTTTAATTTCCTTGGAATGGTG
TTTGCTGCTCTTGGTGTTTTAGTTACATCCCTTTATCAAGTGTGGGTAGGAGCCAAACAGCAT
GAATTACAAGTGAACTCAATGCAGCTGCTGTACTACCAGGCTCCGATGTCATCTGCCATGTTG
CTGGTTGCTGTGCCCTTCTTTGAGCCAGTGTTTGGAGAAGGAGGAATATTTGGTCCCTGGTCA
GTTTCTGCTTTGCTTATGGTGCTGCTATCTGGAGTAATAGCTTTCATGGTGAACTTATCAATT
TATTGGATCATTGGGAACACTTCACCTGTCACCTATAACATGTTCGGACACTTCAAGTTCTGC
ATTACTTTATTCGGAGGATATGTTTTATTTAAGGATCCACTGTCCATTAATCAGGCCCTTGGC
ATTTTATGTACATTATTTGGCATTCTCGCCTATACCCACTTTAAGCTCAGTGAACAGGAAGGA
AGTAGGAGTAAACTGGCACAACGTCCTTAATTGGGTTTTTGTGGAGAAAAGAATGTTGTCCCA
AGAAGATAAAAAATATTGTTAAGTGTGCAAGTTATTA

FIGURE 554

></usr/seqdb2/sst/DNA/Dnaseqs.min/ss.DNA125170
><subunit 1 of 1, 313 aa, 1 stop
><MW: 35066, pI: 9.39, NX(S/T): 5
MALLVDRVRGHWRIAAGLLFNLLVSICIVFLNKWIYVYHGFPNMSLTLVHFVVTWLGLYI
CQKLDIFAPKSLPPSRLLLLALSFCGFVVFTNLSLQNNTIGTYQLAKAMTTPVIIAIQTF
CYQKTFSTRIQLTLIPITLGVILNSYYDVKFNFLGMVFAALGVLVTSLYQVWVGAKQHEL
QVNSMQLLYYQAPMSSAMLLVAVPFFEPVFGEGGIFGPWSVSALLMVLLSGVIAFMVNLS
IYWIIGNTSPVTYNMFGHFKFCITLFGGYVLFKDPLSINQALGILCTLFGILAYTHFKLS
EQEGSRSKLAQRP

Important features of the protein:
Signal peptide:
Amino acids 1-27

Transmembrane domains:
Amino acids 46-60;75-90;153-167;192-208;221-237

N-glycosylation sites:
Amino acids 43-47;92-96;97-101;238-242

N-myristoylation sites:
Amino acids 17-23;57-63;140-146;155-161;162-168;283-289

FIGURE 555

GTTAGGCAGAGCCAAGGTGGTTGCAGACCTGGAATCAGAACAGCTTTTAGACCAACCTGAAAG
CAGGAATGTAAGCACTGTTCACAGAGATTTTCGTCTTTGGCTTATTGTGCCTGCAGAGTCTAG
TGCTTCTTTGCCAGCTGTGCTGACTCAGCACTCCATGCCTGTTTTCTGGAACCAGTCCCTGGA
GCTGGGCCATGTTTTGATTGACAGTGTGGAGCTAGCCCAGCAAGTACTCTACATGCAACCCCC
CACCCAGGCACTACCTCTGCTCCTCCTCCATGGCCTCCTGCTACACCGGCAGCTCTATGGAAC
AAGGCTGCAGGCACACAGGGGGCGCTGGAGTCAAGTGACTCTAACCCAGGTTCTTCAGACCCA
AGACCAGCTGTGGGCAAGTCTTAGCAATCCCCGTGCTGCCATGCAAGAGCTGGCTGCTTCAGT
TTTCTACGGGGGTCCTCTGGGGGACACTGAGGACAGGGAGGCCCTGATTAGCCTCACACAAGC
CTGCCTGAGCCCCAGTAGTGGGAGCTGGGTCCAGCCACACACACCTCAGTCTTTGCTGGCCAC
GCTCATGCCCCTCCCAGCTAAGGGAGCTGGATGCAATGGCAGAGTGCAAGGCCCAGATGCACC
TACTGCCCTCACCACCTGAACCCCGGCTCTGCGGACTGAGTGAGGGCCCCCAAGCCTGGCTGT
TGCGACGCCAGAGTCGCGCTCTCTTGAGTGCGCTGCAGCGGAGTTCACCCGTGTGGGTTCCTG
AGTCTCGAAGAGGCGCCCAGCTTGCGGAAAGGCGACTGCGGCAACGCCTAGTGCAAGTCAACCG
GAGGCTGGAGTCACTGCAGGATCTGCTGACCCACGTGATTCGCCAAGACGAGTCCGACGCCCC
GTGGTCAGTGCTGGGGCCAAATGCACGGCGGCCTCTGGAGGGCGTCTTAGAGACCGAGGCTCT
AGAACTGAGCCAGTTGGTGGGCACGCTACAACGCGACCTTGATTGCCTGTTGCAGCAGCTGAA
GGGCGCACCCCCGTGCCCCTCCCGCCGCTGTGCTGCGGTGGCCCACGCTCTCTGGACTGGCCG
CCTACCCTTGCCTTGGCGACCTCATGCGCCGGCCGGTCCGCAGCCGCCCTGGCACTGGCTGCG
ACAGTTGTCGCGCCGTGGGCAACTGTTGGTTCGTTACTTGGGCGTGGGCGCGGACGCGAGCAG
TGATGTACCAGAGCGCGTCTTCCACCTGTCAGCCTTTCGCCACCCGCGCCGCCTGCTGCTGGC
ATTGCGTGGGGAAGCTGCCCTGGACCAGAATGTGCCCAGCTCGAATTTCCCTGGTAGCCGAGG
CTCGGTCTCCAGTCAGCTCCAGTATAAACGTCTGGAGATGAACAGCAACCCCTCTGCACTTCAG
GGTGGAGAATGGTCCAAATCCCACGGTTCCAGAGAGAGGGCTGCTGCTGATCGGGCTACAGGT
CCTACATGCGGAGTGGGACCCAATAGCTGGAGCCTTGCAGGACAGTCCTTCCAGCCAACCCAG
CCCTCTGCCTCCCGTCAGCATCAGCACACAGGCCCCGGGCACCAGTGACCTGCCAGCCCCAGC
CGACCTGACTGTGTACTCGTGTCCTGTGTACATGGGAGGGCCCCTTGGCACCGCTAAGCTGCA
GAGCAGGAACATCGTGATGCATCTGCCTTTACCCACCAAGCTCACCCCCAACACCTGTGTCCA
AAGGAGGGTCCATGTGTGCAGCCCACCCCTGTCTTGAGCCCGTCTACCAAAATAAAGTTGTAG
TGATTCCA

FIGURE 556

></usr/seqdb2/sst/DNA/Dnaseqs.min/ss.DNA129594
><subunit 1 of 1, 162 aa, 1 stop
><MW: 17598, pI: 6.58, NX(S/T): 1
MPVFWNQSLELGHVLIDSVELAQQVLYMQPPTQALPLLLLHGLLLHRQLYGTRLQAHRGR
WSQVTLTQVLQTQDQLWASLSNPRAAMQELAASVFYGGPLGDTEDREALISLTQACLSPS
SGSWVQPHTPQSLLATLMPLPAKGAGCNGRVQGPDAPTALTT

Important features of the protein:
Signal peptide:
Amino acids 1-45

N-glycosylation site:
Amino acids 6-10

N-myristoylation sites:
Amino acids 97-103;144-150

FIGURE 557

GACCTTGAGCCCTCGAAAGCGACATGGCGGTTCTCTTAAAGCTGGGCGTTCTCTGCAGTGGCC
AAGGAGCTCGAGCTCTCCTACTCCGAAGCCGGGTGGTCAGACCCGCTTATGTGTCAGCATTTC
TCCAGGACCAGCCTACCCAAGGACGGTGTGGTACCCAGCACATTCACCTGTCACCAAGCCACC
ACTCTGGTTCCAAGGCTGCATCTCTCCACTGGACCAGTGAGAGGGTTGTCAGTGTTCTGCTCT
TGGGGCTGATCCCTGCTGGGTACTTGAATCCCTGCTCTGTGGTGGACTACTCTCTGGCTGCAG
CCCTCACCCTGCACAGTCACTGGGGCCTTGGACAAGTGGTTACCGACTACGTTCATGGGGACA
CCCTGCCGAAGGCTGCCAGGGCAGGCCTCTTGGCACTCTCAGCTTTGACCTTTGCTGGGCTTTGC
TACTTCAATTACCACGATGTCGGCATCTGCAGAGCGGTTGCCATGCTGTGGAAGCTCTGACCT
GGGTGCAGCACTTTGATTGTGTGCCTCCTTGCCTCTGCTTTACCAATGCCGTTCACCTCGCAG
TGAGGGGGGATGAAGGATAAGCCCATTGGTGGGCAGAATGTCTTCTAATTACATGGTTATTTT
CAGAATTTATTTGTTGAGGAAGAGGTTTGAGGAGTTAGGTTCGACCATTCGTGAGTCTGTGTT
CCATACTCCACTGAGTGTGGGCACTAGCTCACAGCCTCGCGGTGAGACTGAACATTTCATGAG
CTCATGTTGCCTTTGACCACCATTTCTTAAGGAGAGCCAGCTGATTGCTGTCAGGATAAGAGC
ATCTCTTCAGCCAGGAGGGAGGCCTGTTCCCTCCTGAGTTAGACTTTGCATGAAGCTCGAAAG
TATTCCCTTTGGAACCTCCCATTCTTGTTCAGGTGACACCAGCTCTGTTGATGGCTCTGCTTC
TAGGGAACATTTAATCAGGAGATGCTCTCAATGACTAATTTGTCTAAGTCTTAGGAAGGAGGT
TGAGGAAAGCTGGATTTAGACAAGTTCAATTTAGGGAGTTCTCCTTGTTTGTGGATTAAAATA
TGACAGATTGCAAACAGACTACTCTTCAAATGTATCTCAATTGTGCAGAAGTGAGCTGTCCAA
AAGTATAAGACTAAGTGATAAACTGTCTTCCCACCGTGGGAGTTGTTAATGAGAAAGAAAGTG
TACTCTGAAAAAACAAGGGGG

FIGURE 558

></usr/seqdb2/sst/DNA/Dnaseqs.min/ss.DNA129793
><subunit 1 of 1, 159 aa, 1 stop
><MW: 17014, pI: 9.38, NX(S/T): 0
MAVLLKLGVLCSGQGARALLLRSRVVRPAYVSAFLQDQPTQGRCGTQHIHLSPSHHSGSK
AASLHWTSERVVSVLLLGLIPAGYLNPCSVVDYSLAAALTLHSHWGLGQVVTDYVHGDTL
PKAARAGLLALSALTFAGLCYFNYHDVGICRAVAMLWKL

Important features of the protein:
Signal peptide:
Amino acids 1-15

Transmembrane domains:
Amino acids 71-88;126-140

Glycosaminoglycan attachment site:
Amino acids 12-16

N-myristoylation sites
Amino acids 8-14;58-64;78-84;108-114;148-154

FIGURE 559

CCCAGCCCCGCGTTCGGCTGCTCTCGAGGAGGCCGGAGTCCCCGGAGACGATGCGCCCCGCGC
AGCCGCCTGCGCCTGCGGGAGCCGGCTGCCCTTGAGATGGAGTTGCTGCCTCTTTGGCTCTGC
CTGGGTTTTCACTTCCTGACCGTGGGCTGGAGGAACAGAAGCGGAACAGCCACAGCAGCCTCC
CAAGGAGTCTGCAAGTTGGTGGGTGGAGCCGCTGACTGCCGAGGGCAGAGCCTCGCTTCGGTG
CCCAGCAGCCTCCCGCCCCACGCCCGGATGCTCACCCTGGATGCCAACCCTCTCAAGACCCTG
TGGAATCACTCCCTCCAGCCTTACCCTCTCCTGGAGAGCCTCAGCCTGCACAGCTGCCACCTG
GAGCGCATCAGCCGCGGCGCCTTCCAGGAGCAAGGTCACCTGCGCAGCCTGGTCCTGGGGGAC
AACTGCCTCTCAGAGAACTACGAAGAGACGGCAGCCGCCCTCCACGCCCTGCCGGGCCTGCGG
AGGCTGGACTTGTCAGGAAACGCCCTGACGGAGGACATGGCAGCGCTCATGCTCCAGAACCTC
TCCTCGCTGCGGTCCGTGTCCCTGGCGGGGAACACCATCATGCGGCTGGACGACTCCGTCTTC
GAGGGCCTGGAGCGTCTCCGGGAGCTGGATCTGCAGAGGAACTACATCTTCGAGATCGAGGGC
GGCGCTTTCGACGGCCTGGCTGAGCTGAGGCACCTCAACCTGGCCTTCAACAACCTCCCCTGC
ATCGTGGACTTCGGGCTCACGCGGCTGCGGGTCCTCAACGTCAGCTACAACGTCCTGGAGTGG
TTCCTCGCGACCGGGGGAGAGGCTGCCTTCGAGCTGGAGACGCTGGACCTGTCTCACAACCAG
CTGCTGTTCTTCCCGCTGCTGCCCCAGTACAGCAAGTTGCGGACCCTCCTGCTGCGCGACAAC
AACATGGGCTTCTACCGGGACCTGTACAACACCTCGTCGCCGAGGGAGATGGTGGCCCAGTTC
CTCCTCGTGGACGGCAACGTGACCAACATCACCACCGTCAGCCTCTGGGAAGAATTCTCCTCC
AGCGACCTCGCAGATCTCCGCTTCCTGGACATGAGCCAGAACCAGTTCCAGTACCTGCCAGAC
GGCTTCCTGAGGAAAATGCCTTCCCTCTCCCACCTGAACCTCCACCAGAATTGCCTGATGACG
CTTCACATTCGGGAGCACGAGCCCCCCGGAGCGCTCACCGAGCTGGACCTGAGCCACAACCAG
CTGTCGGAGCTGCACCTGGCTCCGGGGCTGGCCAGCTGCCTGGGCAGCCTGCGCTTGTTCAAC
CTGAGCTCCAACCAGCTCCTGGGCGTCCCCCCTGGCCTCTTCGCCAATGCTAGGAACATCACTAC
ACTTGACATGAGCCACAATCAGATCTCACTTTGTCCCCTGCCAGCTGCCTCGGACCGGGTGGG
CCCCCCTAGCTGTGTGGATTTCAGGAATATGGCATCTTTAAGGAGCCTGTCTCTGGAGGGCTG
TGGCCTGGGGGCATTGCCAGACTGCCCATTCCAAGGGACCTCCCTGACCTACTTAGACCTCTC
AAGCAACTGGGGGGTTCTGAATGGGAGCCTCGCCCCACTCCAGGATGTTGCCCCCCATGTTACA
GGTCCTGTCTCTCAGGAACATGGGCCTCCACTCCAGCTTTATGGCGTTGGACTTCTCTGGGTT
TGGGAATCTCAGGGACTTAGATCTGTCGGGGAATTGCTTGACCACCTTCCCAAGGTTTGGGGG
CAGCCTGGCCCTGGAGACCCTGGATCTCCGTAGAAACTCGCTCACAGCCCTTCCCCAGAAGGC
TGTGTCTGAGCAGCTCTCGAGAGGTCTGCGGACCATCTACCTCAGTCAGAATCCATATGACTG
CTGTGGGGTGGATGGCTGGGGGGCCCTGCAGCATGGGCAGACGGTGGCCGACTGGGCCATGGT
CACCTGCAACCTCTCCTCCAAGATCATCCGCGTGACGGAGCTGCCCGGAGGTGTGCCTCGGGA
CTGCAAGTGGGAGCGGCTGGACCTGGGCCTGCTCTACCTCGTGCTCATCCTCCCCAGCTGCCT
CACCCTGCTGGTGGCCTGCACTGTCATCGTCCTCACTTTTAAGAAGCCTCTGCTTCAGGTCAT
CAAGAGCCGCTGCCACTGGTCCTCCGTTTACTGACCTGGCTGTGTGCCAAGACTCGAAATTCG
GTCCGCACACAACAGGACACTTTCTCTGCCAGCTTTCAAGATGTGATGCAGAGGCCAAGTCTG
ACGAATTGAAGTTTCAATTAAAATTTAATATGTTTCCATTCCTCATCGCCCACCCCACCCCCG
CCCCCACCACCGCCCAAGTTCTTTTTCCATCATTATAATTCATCCTTATTATCTTGGTAAAAT
ATTTATTAAGTGACTTTTTCAGAAATAAAAGGCAACGTGTCTCATAAATATTTTTTAAAAAAA
AAAAAAAAAAAAA

FIGURE 560

```
><subunit 1 of 1, 692 aa, 1 stop
><MW: 76366, pI: 6.07, NX(S/T): 11
MELLPLWLCLGFHFLTVGWRNRSGTATAASQGVCKLVGGAADCRGQSLASVPSSLPPHAR
MLTLDANPLKTLWNHSLQPYPLLESLSLHSCHLERISRGAFQEQGHLRSLVLGDNCLSEN
YEETAAALHALPGLRRLDLSGNALTEDMAALMLQNLSSLRSVSLAGNTIMRLDDSVFEGL
ERLRELDLQRNYIFEIEGGAFDGLAELRHLNLAFNNLPCIVDFGLTRLRVLNVSYNVLEW
FLATGGEAAFELETLDLSHNQLLFFPLLPQYSKLRTLLLRDNNMGFYRDLYNTSSPREMV
AQFLLVDGNVTNITTVSLWEEFSSSDLADLRFLDMSQNQFQYLPDGFLRKMPSLSHLNLH
QNCLMTLHIREHEPPGALTELDLSHNQLSELHLAPGLASCLGSLRLFNLSSNQLLGVPPG
LFANARNITTLDMSHNQISLCPLPAASDRVGPPSCVDFRNMASLRSLSLEGCGLGALPDC
PFQGTSLTYLDLSSNWGVLNGSLAPLQDVAPMLQVLSLRNMGLHSSFMALDFSGFGNLRD
LDLSGNCLTTFPRFGGSLALETLDLRRNSLTALPQKAVSEQLSRGLRTIYLSQNPYDCCG
VDGWGALQHGQTVADWAMVTCNLSSKIIRVTELPGGVPRDCKWERLDLGLLYLVLILPSC
LTLLVACTVIVLTFKKPLLQVIKSRCHWSSVY
```

Important features of the protein:

Signal peptide:
Amino acids 1-18

Transmembrane domain:
Amino acids 651-672

N-glycosylation sites:
Amino acids 21-25;74-78;155-159;232-236;292-296;309-313;
312-316;408-414;427-431;500-504;622-626

Glycosaminoglycan attachment site:
Amino acids 533-537 cAMP- and cGMP-dependent protein kinase phosphorylation site:
Amino acids 566-570

N-myristoylation sites:
Amino acids 24-30;39-45;45-51;141-147;199-205;245-251;
308-314;396-402;416-422;420-426;471-477;
484-490;497-503;522-528;545-551;555-561;610-616

Prokaryotic membrane lipoprotein lipid attachment site:
Amino acids 657-668

Leucine zipper patterns:
Amino acids 48-70;492-514

FIGURE 561

TGGCCTACTGGAAAAAAAAAAAAAAAAAAAAAAAGTCACCCGGGCCCGCGGTGGCCACAACAT
GGCTGCGGCGCCGGGGCTGCTCTTCTGGCTGTTCGTGCTGGGGGCGCTCTGGTGGGTCCCGGG
CCAGTCGGATCTCAGCCACGGACGGCGTTTCTCGGACCTCAAAGTGTGCGGGGACGAAGAGTG
CAGCATGTTAATGTACCGTGGGAAAGCTCTTGAAGACTTCACGGGCCCTGATTGTCGTTTTGT
GAATTTTAAAAAAGGTGACGATGTATATGTCTACTACAAACTGGCAGGGGGATCCCTTGAACT
TTGGGCTGGAAGTGTTGAACACAGTTTTGGATATTTTCCAAAAGATTTGATCAAGGTACTTCA
TAAATACACGGAAGAAGAGCTACATATTCCAGCAGATGAGACAGACTTTGTCTGCTTTGAAGG
AGGAAGAGATGATTTTAATAGTTATAATGTAGAAGAGCTTTTAGGATCTTTGGAACTGGAGGA
CTCTGTACCTGAAGAGTCGAAGAAAGCTGAAGAAGTTTCTCAGCACAGAGAGAAATCTCCTGA
GGAGTCTCGGGGGCGTGAACTTGACCCTGTGCCTGAGCCCGAGGCATTCAGAGCTGATTCAGA
GGATGGAGAAGGTGCTTTCTCAGAGAGCACCGAGGGGCTGCAGGGACAGCCCTCAGCTCAGGA
GAGCCACCCTCACACCAGCGGTCCTGCGGCTAACGCTCAGGGAGTGCAGTCTTCGTTGGACAC
TTTTGAAGAAATTCTGCACGATAAATTGAAAGTGCCGGGAAGCGAAAGCAGAACTGGCAATAG
TTCTCCTGCCTCGGTGGAGCGGGAGAAGACAGATGCTTACAAAGTCCTGAAAACAGAAATGAG
TCAGAGAGGAAGTGGACAGTGCGTTATTCATTACAGCAAAGGATTTCGTTGGCATCAAAATCT
AAGTTTGTTTTACAAAGATTGTTTTTAGTACTAAGCTGCCTTGGCAGTTTGCATTTTTGAGCC
AAACAAAAATATATTATTTTCCCTTCTAAGTAAAAAAAAAAAAAAAAAAAAAA

FIGURE 562

></usr/seqdb2/sst/DNA/Dnaseqs.min/ss.DNA131639
><subunit 1 of 1, 303 aa, 1 stop
><MW: 33900, pI: 4.81, NX(S/T): 2
MAAAPGLLFWLFVLGALWWVPGQSDLSHGRRFSDLKVCGDEECSMLMYRGKALEDFTGPD
CRFVNFKKGDDVYVYYKLAGGSLELWAGSVEHSFGYFPKDLIKVLHKYTEEELHIPADET
DFVCFEGGRDDFNSYNVEELLGSLELEDSVPEESKKAEEVSQHREKSPEESRGRELDPVP
EPEAFRADSEDGEGAFSESTEGLQGQPSAQESHPHTSGPAANAQGVQSSLDTFEEILHDK
LKVPGSESRTGNSSPASVEREKTDAYKVLKTEMSQRGSGQCVIHYSKGFRWHQNLSLFYK
DCF

Important features of the protein:
Signal peptide:
Amino acids 1-22

N-glycosylation site:
Amino acids 294-298 cAMP- and cGMP-dependent protein kinase phosphorylation site:
Amino acids 30-34

Tyrosine kinase phosphorylation site:
Amino acids 67-76

N-myristoylation sites:
Amino acids 205-211;225-231;277-283

Amidation site:
Amino acids 28-32

FIGURE 563

GCCAGCCGTGGGATTAGGCTTCGCCGGCTACGATTGCGGCCCCCATCTTCTGACTTTTCCTCG
TGTGACCCATCTTTTCAAATTCCCTTACCTGAGGAAGGAGCCCGATTACAAGGATATTTACCT
GCTCCTACCCTGATCTAGGGACGAGGATGGGAAGACCGCCTGTGGCCATGAGCCCTCCCCGGT
GCTCCTGGGGCTAAGGCTGGGGCTGCAGCCATGGGGCTGGGTCAGCCCCAGGCCTGGTTGCTG
GGTCTGCCCACAGCTGTGGTCTATGGCTCCCTGGCTCTCTTCACCACCATCCTGCACAATGTC
TTCCTGCTCTACTATGTGGACACCTTTGTCTCAGTGTACAAGATCAACAAAATGGCCTTCTGG
GTCGGAGAGACAGTGTTTCTCCTCTGGAACAGCCTCAATGACCCTCTCTTCGGTTGGCTCAGT
GACCGGCAGTTCCTCAGCTCCCAGCCCCGCCTGTGTGGAGAGGAGCTGCTTGTGGGCAGTGAG
GAGGCGGACAGCATCACCTTGGGCCGGTATCTCCGGCAGCTGGCACGCCATCGGAACTTCCTG
TGGTTCGTGAGCATGGACCTGGTGCAGGTGCAGTGGCTCACGCCTGTAATCCCAGCACTTCGG
GACGCCAAGGTGGAAAGACCGCTTGAGCCCAGGAGTTCGAGGCTGCAATGAGTTATGATTGCA
CCACTGCACTCCAGCCTGGGCGGCAGAGAAAGGCTCCATCTCTAAAAAAAGAAGAGCTAAGTG
CTGTACCTAAAACATGCAGTATATAAACTGGCTGAACTTAGAAATAAACTGTTTTCATGTTAT
GAAAA

FIGURE 564

></usr/seqdb2/sst/DNA/Dnaseqs.min/ss.DNA131649
><subunit 1 of 1, 153 aa, 1 stop
><MW: 17603, pI: 7.42, NX(S/T): 0
MGLGQPQAWLLGLPTAVVYGSLALFTTILHNVFLLYYVDTFVSVYKINKMAFWVGETVFL
LWNSLNDPLFGWLSDRQFLSSQPRLCGEELLVGSEEADSITLGRYLRQLARHRNFLWFVS
MDLVQVQWLTPVIPALRDAKVERPLEPRSSRLQ

Important features of the protein:
Signal peptide:
Amino acids 1-20

N-myristoylation sites:
Amino acids 4-10;12-18;93-99

Leucine zipper pattern:
Amino acids 102-124

FIGURE 565

CGGCACGAGTAAAATGGAGATAATATCACCATGCACTCAGCCCTAGCCACTGCATTGCTGTTA
CTGATACCATTACTGCTGCTACGTCGTTTTTTTGATGGCTCAGCCCTTAGGGAAGGGGGATCA
AGGGAGAAGCCCGGACCTTCCCGCAGGAGGTGGGCTGGGCACAGCCCTGAACCATGGAGGTCA
CCCACCCTGAGGTCGGGACCTGGGTTCCCTTCCTATCCACTGGGGGTCCCAGCCTTTGTCTTC
ATCTCTCCAGGTCCCAGCCCTTCACAGTGGGCACTTCCCTGCCTGTGACGGAGGCCCCAGCCA
TCTCC

FIGURE 566

></usr/seqdb2/sst/DNA/Dnaseqs.min/ss.DNA131652
><subunit 1 of 1, 89 aa, 1 stop
><MW: 9688, pI: 11.49, NX(S/T): 0
MHSALATALLLLIPLLLLRRFFDGSALREGGSREKPGPSRRRWAGHSPEPWRSPTLRSGP
GFPSYPLGVPAFVFISPGPSPSQWALPCL

Important features of the protein:
Signal peptide:
Amino acids 1-18

Glycosaminoglycan attachment site:
Amino acids 58-62

FIGURE 567

AGTCTAGCAGGAAAGGAGAGGGAGCTTTCCCCGAAGACCCTCCTGGACCAGCCCCAGGCTCCT
GTGCTGGTTGCACGCCAGGGCCTGTACTGACCACCTCCACGTGCCACTGGGGCTGTAAGGAGGA
ATGGCGGCCGTGGGCAGCCTGCTTGGCCTGGCAGCCTCTTCCTGGCTAGGGGGCCAGAACGCC
TCTGACCACAGCCTGTGGCTCCTGAGGAAGCCCCGAGGCTCATCCTGCCCCGGCACGGGTCAC
CAGCTCTGCCGGCTGAGGCAGAGCACCGTGAAGGCCACCGGACCTGCACTCCGCCGCCTGCAC
ACATCCTCCTGGCGAGCTGACAGCAGCAGGGCCTCACTCACTCGTGTGCACCGCCAGGCTTAT
GCACGACTCTACCCCGTGCTGCTGGTGAAGCAGGATGGCTCCACCATCCACATCCGCTACAGG
GAGCCACGGCGCATGCTGGCGATGCCCATAGATCTGGACACCCTGTCTCCTGAGGAGCGCCGG
GCCAGGCTGCGGAAGCGTGAGGCTCAGCTCCAGTCGAGGAAGGAGTACGAGCAGGAGCTCAGT
GATGACTTGCATGTGGAGCGCTACCGACAGTTCTGGACCAGGACCAAGAAGTGACCGTGGCTC
CAGCCACCCCGGGACATTGCTAAGATGGGAGGGCTGTTCTTAAATCACTCGTTCTTGAAGCTGC

FIGURE 568

></usr/seqdb2/sst/DNA/Dnaseqs.min/ss.DNA131658
><subunit 1 of 1, 164 aa, 1 stop
><MW: 18903, pI: 11.08, NX(S/T): 1
MAAVGSLLGLAASSWLGGQNASDHSLWLLRKPRGSSCPGTGHQLCRLRQSTVKATGPALR
RLHTSSWRADSSRASLTRVHRQAYARLYPVLLVKQDGSTIHIRYREPRRMLAMPIDLDTL
SPEERRARLRKREAQLQSRKEYEQELSDDLHVERYRQFWTRTKK

Important features of the protein:
Signal peptide:
Amino acids 1-18

N-glycosylation site:
Amino acids 20-24

N-myristoylation sites:
Amino acids 5-11;9-15;17-23;18-24

FIGURE 569

GGTGCCAAGGGTTCGGGGGGGAGCACTGAGGCTTTAGCAGCTCTCCTGTATCCTCATTTGCAT
CCTCCTGTAGCAGCTGGAAAATTCAGATTACAGGTGAAATTCCCTGGCTGGCAATCTTCTGTA
TATGGACACAGTGATGTGCCAGAAGGGCTTTGCATCCCTGAGACTGAAGGAAGCTCCATTTTT
GGAGCCCTCCCACACCTTGCTCTGTGTGCCTCTCATTCTGATTTGAATTCTTATTTTGCTATA
TGATGAAGCTGTAATCCTAAGTTTAAAAAGGGGAGTAGGTATTGACATCATGGTAGAAATAGG
CTGTCTTATGGAACTGTAGTTAGGGATCACAGCCTATTGGACCAGCCCCAGCCTTAGCAGCAG
TTCTGTACACTGATTCTTCCAGATTAGTCTACGTTCCCTCGAACAGACCTATGCCATGGGTTA
CAACTACAATTTGTTGTCGATTAGAGTTAACTTACAGACTCTCAAAACCCCATTCTTTGGGTT
TAGGCAACTTCCAGAAGTAGTCATTTATTTGAATTTTAGTCTAAGATCAACTGAATTAGGGAG
GTTTGAAAGTGTAAAAGCAAATCGTACATTCCCAAACACTTTGTAAAGAAGGAATGGGTAGTG
TCAACTAAAGGAAATGGTGTGCATCCCAGCAAAAGAAAGAGACCGAAAGCAAAGTCATAAACC
ATGCCCACGAGCTCAGCTGTCCTGCTCCGTGTCCTCTCCATACCCTTGTTGACTGTGCTCATA
TTAGCCAGAGACCTAAGTGCTCTTGGAGGATGTCCCTGGGGCCCCCTCCCCCTCCGCTGTCAC
TGTCTACTTCCTGATCCTCTCTTCTGTGCAGGAGAGGTCCAGGCCTTCTATGAGGACCTGAGT
GGCCGGCAGTACGTGAATGAAGTCTTCAACTTCAGCGTGGACAAGCTCTATGACCTCCTCTTC
ACCAACTCGCCCTTCCAGCGGGATTTCATGGAGCAGCGGCGCTTCTCTGATATCATCTTCCAT
CCATGGAAAAAGGAGGAGAATGGAAACCAGAGCCGAGTGATTCTTTACACCATCACCCTTACC
AACCCTCTGGCTCCCAAAACTGCCACTGTCAGGGAGACACAGACCATGTACAAGGCGAGCCAG
GAGAGTGAATGTTACGTGATAGATGCCGAAGTCCTCACCCACGACGTGCCCTACCACGACTAC
TTCTACACAATCAATCGCTACACGCTCACCCGTGTGGCTCGGAACAAGAGCCGACTCAGGGTC
TCCACAGAGCTGCGCTATCGAAAACAGCCCTGGGGGTTAGTGAAAACGTTCATCGAGAAGAAC
TTCTGGAGTGGGCTGGAGGACTACTTCCGCCATTTAGAGAGCGAGCTGGCCAAAACGGAGAGC
ACTTATTTGGCTGAGATGCACAGACAATCTCCCAAAGAGAAGGCCAGCAAGACTACAACGGTG
CGGAGGAGGAAGCGTCCCCATGCCCACCTGCGAGTCCCTCACCTGGAAGAGGTGATGAGCCCG
GTCACCACGCCCACAGATGAGGATGTGGGCCACAGGATCAAACATGTGGCAGGTTCCACACAG
ACGCGGCATATCCCGGAGGACACCCCCAACGGTTTCCACCTGCAGAGCGTGTCCAAGCTGCTG
CTGGTTATCAGCTGTGTTCTGGTGCTGCTGGTCATCCTTAACATGATGCTCTTCTACAAACTC
TGGATGTTGGAATACACCACGCAGACCCTCACTGCCTGGCAGGGTCTAAGGCTCCAAGAAAGG
TTACCCCAGTCTCAGACAGAATGGGCCCAGCTCTTAGAGTCCCAACAAAAGTACCACGATACT
GAGCTCCAAAAAATGGAGGGAAATCATCAAATCCTCAGTGATGCTCCTTGACCAGATGAAGGAC
TCGCTCATCAACCTTCAGAACGGCATCAGGTCCCGCGACTACACGTCGGAAAGTGAAGAAAAG
AGGAATCGCTATCATTGACAAGGCAGGAACAGGGTGGCTGCAAGAGGCCTGTGCAATACATGT
ACATAGACCATATAAATATATATATATAAATATATATATATACAGAATATAAATATATATATT
ATATACAGATTTTAAAAAAGAGATAATGCCTATGTACCAGGGAGAAGGAGCGGGCCCTCCCGC
GCCCTGTGCTGGCCGGAGCAGCGTTTTCTTATGGTGGAGCAGCTGAGGAGGGCAGGAACCGCC
TCTCAGCACCGACCTCCCCTGATCTCCCTCCTCCCACCCTCTGTTCCCCACCCCTTCCCTTGC
TGGCCATTCTTGGCTTTTAGAAGGGAAATGTTGAGCCAAAGTTATGCCTGCGAAGACCCTAAG
GTCTCAAAAAGAAGTCTTAAGACGGCATTGCTTAAGGTGCTTCATTCCCTAATCCCCTTTTGA
TTTGTTTCCAAAATAAAAGAGAATCTTTTCTTCCCTAAAAAAAAAAAAAAAAAAAAAAAAAAA

FIGURE 570

><subunit 1 of 1, 425 aa, 1 stop
><MW: 49786, pI: 8.84, NX(S/T): 3
MPTSSAVLLRVLSIPLLTVLILARDLSALGGCPWGPLPLRCHCLLPDPLFCAGEVQAFYE
DLSGRQYVNEVFNFSVDKLYDLLFTNSPFQRDFMEQRRFSDIIFHPWKKEENGNQSRVIL
YTITLTNPLAPKTATVRETQTMYKASQESECYVIDAEVLTHDVPYHDYFYTINRYTLTRV
ARNKSRLRVSTELRYRKQPWGLVKTFIEKNFWSGLEDYFRHLESELAKTESTYLAEMHRQ
SPKEKASKTTTVRRRKRPHAHLRVPHLEEVMSPVTTPTDEDVGHRIKHVAGSTQTRHIPE
DTPNGFHLQSVSKLLLVISCVLVLLVILNMMLFYKLWMLEYTTQTLTAWQGLRLQERLPQ
SQTEWAQLLESQQKYHDTELQKWREIIKSSVMLLDQMKDSLINLQNGIRSRDYTSESEEK
RNRYH

Important features of the protein:
Signal peptide:
Amino acids 1-28

Transmembrane domain:
Amino acids 312-334

N-glycosylation sites:
Amino acids 73-77;114-118;183-187 cAMP- and cGMP-dependent protein kinase phosphorylation site:
Amino acids 97-101

Tyrosine kinase phosphorylation sites:
Amino acids 144-153;188-196

N-myristoylation sites:
Amino acids 201-207;291-297

Leucine zipper pattern:
325-347

FIGURE 571

GTAGAGAGTGAAGCAGCAAGACTGCAGAGCCTCATCAAGAAGTGTGGAGTGAAGGGAAGGCTTCAGATGGACAAT
TTGTGTGCTGGGGAAAAAATGGAATGTGCTGCAAATTCCCCTGTGGATAAGGGTGGACGGCTGCTCTGTCAACTT
TGACCATTTTCAGATTCTGCGGGCCATTGGTAAAGGGAGTTTTGGAAAGGTATGCATCGTGCAGAAGCGAGACAC
TAAGAAAATGTATGCAATGAAGTACATGAACAAGCAGAAGTGCATCGAGAGGGATGAGGTTCGGAATGTTTTCCG
GGAGCTGCAGATCATGCAAGGGCTGGAGCACCCCTTCCTGGTCAATCTGTGGTACTCCTTCCAGGATGAGGAGGA
CATGTTCATGGTGGTGGACCTGCTCCTGGGAGGCGACCTGCGCTACCATCTGCAGCAGAATGTGCATTTCACAGA
GGGGACTGTGAAACTCTACATCTGTGAGCTGGCACTGGCCCTGGAGTATCTTCAGAGGTACCACATCATCCACAG
AGACATCAAGCCAGACAATATCCTGCTGGATGAACACGGACATGTTCACATTACAGACTTCAACATAGCGACGGT
AGTGAAAGGAGCAGAAAGGGCTTCCTCCATGGCTGGCACCAAGCCCTACATGGCTCCAGAAGTATTCCAGGTGTA
CATGGACAGAGGCCCCGGATACTCGTACCCTGTCGACTGGTGGTCCCTGGGCATCACAGCCTATGAGCTGCTGCG
GGGCTGGAGGCCGTACGAAATCCACTCGGTCACGCCCATCGATGAAATCCTTAACATGTTCAAGGTGGAGCGTGT
CCACTACTCCTCCACGTGGTGCAAGGGGATGGTGGCCCTGCTGAGGAAGCTCCTGACCAAGGATCCTGAGAGCCG
CGTGTCCAGCCTTCATGACATACAGAGCGTGCCCTACTTGGCCGACATGAACTGGGACGCGGTGTTCAAGAAGGC
ACTGATGCCCGGCTTTGTGCCCAATAAAGGGAGGTTGAACTGCGATCCCACATTTGAGCTTGAAGAGATGATTCT
AGAATCCAAGCCACTTCACAAAAAGAAGAAGCGATTGGCAAAGAACAGATCCAGGGATGGCACAAAGGACAGCTG
CCCGCTGAATGGACACCTGCAGCACTGTTTGGAGACTGTCCGGGAGGAATTCATCATATTCAACAGAGAGAAGCT
CAGGAGGCAGCAGGGACAGGGCAGCCAGCTCTTGGACACCGACAGCCGAGGGGGAGGCCAGGCCCAAAGCAAGCT
CCAGGACGGGTGCAACAACAACCTCCTCACCCACACCTGCACCCGTGGCTGCAGCAGCTGAGCCCACACTTGTTG
CTGCTCAACAGGACTGCACTCGTCTCTGCCCTGCCCACCCAGAGCCCCTCTTTGTGCCCTGATGGTCCCTGTCTC
ACCCCTGAAAACATCAGATGCAGAAAAAGCCCTGGACTTGGAGCTGGGAAGCCTGGGTTCTGGTCCCATCTCCAT
GACTGATTCACGTGTGACCTCAGACAAGTCACGCCCTCTCTGTGCCTCCGTTTTCTGCATCTGCCAAAGGGGTTA
AACACTTCTGCCCCACTTCAAATTACAAGATTATGGGGAGAACCCAATTAGGTAGGAAACATGAAAAACCTTTGA
TATTTATAAAATCATTTTTACGTGCAAAATATAACCTTAATATTTGAAGTGACCCCCATTCCCCAAAGCAATCAA
ACCGTCATGACTTTGCAATTTGGCACATCCTAGCTTGTTAGAGGGCACTTCCGAAAAACACAGCCCTGACAGCAA
AATAAAGGTCTGATATGTTGGCCCCTTCTATGGAAACAACGCTGCCAAATCCTGGAGCAAAACCTGAAGTGTCTT
CATGTGCATTCTCTGGCAGGCCACAGTCCTTCTGAGCTTGTAAGATGGTGCAGCATGCAGACCAGACTTGTCCCC
AAGGTCTCAGCGCTGCGGTCTCACTCCTCCCCTCATTTAAGAAGACTATCCTTACCTTTTAGTTTCAGCAGTCCT
CACCACCACCATATCCCCAGTGCTGGGATGGCACACAGGTGTCCATTCAGATGAGAGTTGGGTCGCTGAGCATTG
GTTACTCCTGCAGAGTGTAATCAGCACCCCATCCAACTGGCCCGAAAGCCCAGACCTGCAGCAGAACTCTCCAAC
TCTCTATCAGCTTTCAGGGTTTTCTCTCCTGGGAAGGGTGTAAAATCAGCTTGTCAGATTCTTCTTACAGAGAGT
ATCCAATCGGTATTGGTGGAGCGGCTCCCTATTTATACAATAGGAAGCATGGGTGCTTAGAAAGTTTATTTCAGG
AGGAAAATGGGTTCACACAAAAAGCAAACTACATTCTGATCTGCTCAGGGAGAAGCTTGCCTTTGAACTGGAAGA
TGTTGGGATGAGCAGGGAAAGCTTAGACTTTGGAGTCAGGTTTGTGTTCAGAATCCAGCCCTGCTGGCTACTAAC
TAACTGGGAGACCTTAGGCAAAGCATGCAATCGCTCTGAATGGCAGTTTCCTCATTTTTAAACAGGGATAATAAA
ACTAATATTGCAGGGGAGTTACAGGGTTAAATAAGATCCTGTGTGTAACCCCAAGCATTGGATGACTCATAGAAT
GGCCTTTTTTGTCAGCATAATCGTCATCATTATTTAGATACTTTCTTCCTTCACTCACCCAGCAGGTCAGTTTTC
TGTGCAAACAAACCTGTTTAGGATTCTTCCAAATGTTCTTCCTGGGGTCTTTGATATTTGTTTGTTACATCCTGC
TGAAGTTCGACTGTGTTTTTATTTTTTCATCCAACTTCCATTTTTCACTTTTTACATGATTACTCAATCCTTGGG
GCTGTCCATGTCATCTCTTAGATTTCTTAAAAGACATTTTAATGTATGGTTAGGTTTTATATTTTTATTTTTTAA
AAAAGAAATAGTCAGTGTTTTCCTCCTTTCAACCGAGACTATTTCTGGATTGTGTGCTCCTCGTCAGTTGACTTGT
TTTGCACACTTTTCTTTACTTCATGTCCCCATCAACAACCGTCCTGCTCCCCACCTCCCCCAGGAAATAAGGGGC
CTGCTCCTCTCCCTACTGTGACCCTGGAGGCTCTTAAGATGATGATGGTTTTTTTATTGGGCTGAGTTCACGAA
TTAGGGGCAGGAGCTGGAAGTCGCCCTAGGAACACCAGATTTCCTGGTTCTGTTCAAGTTGGCATTTCTTGTTTG
GAATAAACTATTTCTTGG

FIGURE 572

</usr/seqdb2/sst/DNA/Dnaseqs.min/ss.DNA136110
<subunit 1 of 1, 364 aa, 1 stop
<MW: 42195, pI: 7.40, NX(S/T): 1
MKYMNKQKCIERDEVRNVFRELQIMQGLEHPFLVNLWYSFQDEEDMFMVVDLLLGGDLRY
HLQQNVHFTEGTVKLYICELALALEYLQRYHIIHRDIKPDNILLDEHGHVHITDFNIATV
VKGAERASSMAGTKPYMAPEVFQVYMDRGPGYSYPVDWWSLGITAYELLRGWRPYEIHSV
TPIDEILNMFKVERVHYSSTWCKGMVALLRKLLTKDPESRVSSLHDIQSVPYLADMNWDA
VFKKALMPGFVPNKGRLNCDPTFELEEMILESKPLHKKKKRLAKNRSRDGTKDSCPLNGH
LQHCLETVREEFIIFNREKLRRQQGQGSQLLDTDSRGGGQAQSKLQDGCNNNLLTHTCTR
GCSS

Important features of the protein:

N-glycosylation site:
Amino acids 285-289

N-myristoylation sites:
Amino acids 123-129;290-296;337-343;339-345;348-354

Serine/Threonine protein kinases active-site signature:
Amino acids 92-105

FIGURE 573

CTCCAGTTCGCCGACTGTAACATGTTTCATCCAGTTCAGTATGTTTTGTATGCAAGTTGGAAATAAATAAACGTC
CTGAACTGGATGAAACATGTTACAGTCGGCCGAAACATGAGAGGCTGTGTGAGAAGCTGCAGCCGCCGGCAGAGG
AGACCTCAGCATCATCTAGAGCCCAGCGCTGGCCCTGCCTCCGCCTGCGCCGCCGCCGCCGTCGCCGTTTCTGTT
CCTGCTACTGTCCCACCTAAACAACTCCCGTTACACGGACAAGTGAACATCTGTGGCTGTCCTCTCCTTTTCTTC
CTCCTCTTCCAACTCCTTCTCCTCCTCCCACTTCCCAGCCGCAGCAGAAAGCCCCCAACCCAACTGACGCTGGCA
CAACTGCAAACGGTGTCATCCGCACAACTTTATCTCGCTCCTCGGGCTCCCCTAAGGCATTGGACCCATCGCCGC
GTCTTTTATTTTTGCAAAGTTGCATCGCTGTACATATTTTTGTCCCCGCCACCTCCCTCTGTCTCTGGAGTGCCC
TACAGCCCCGCAAACTCCTCCTGGAGCTGCGCCCTAGTGCCCCTGCTGGGCAGTGGCGTTCCCCCCCATCCTCCC
GCGCCCAGCCCCTGCTGCTCTGGGCAGACGATGCTGAAGATGCTCTCCTTTAAGCTGCTGCTGCTGGCCGTGGCT
CTGGGCTTCTTTGAAGGAGATGCTAAGTTTGGGGAAAGAAACGAAGGGAGCGGAGCAAGGAGGAGAAGGTGCCTG
AATGGGAACCCCCCGAAGCGCCTGAAAAGGAGAGACAGGAGGATGATGTCCCAGCTGGAGCTGCTGAGTGGGGGA
GAGATGCTGTGCGGTGGCTTCTACCCTCGGCTGTCCTGCTGCCTGCGGAGTGACAGCCCGGGGCTAGGGCGCCTG
GAGAATAAGATATTTTCTGTTACCAACAACACAGAATGTGGGAAGTTACTGGAGGAAATCAAATGTGCACTTTGC
TCTCCACATTCTCAAAGCCTGTTCCACTCACCTGAGAGAGAAGTCTTGGAAAGAGACCTAGTACTTCCTCTGCTC
TGCAAAGACTATTGCAAAGAATTCTTTTACACTTGCCGAGGCCATATTCCAGGTTTCCTTCAAACAACTGCGGAT
GAGTTTTGCTTTTACTATGCAAGAAAAGATGGTGGGTTGTGCTTTCCAGATTTTCCAAGAAAACAAGTCAGAGGA
CCAGCATCTAACTACTTGGACCAGATGGAAGAATATGACAAAGTGGAAGAGATCAGCAGAAAGCACAAACACAAC
TGCTTCTGTATTCAGGAGGTTGTGAGTGGGCTGCGGCAGCCCGTTGGTGCCCTGCATAGTGGGGATGGCTCGCAA
CGTCTCTTCATTCTGGAAAAAGAAGGTTATGTGAAGATACTTACCCCTGAAGGAGAAATTTTCAAGGAGCCTTAT
TTGGACATTCACAAACTTGTTCAAAGTGGAATAAAGGGAGGAGATGAAAGAGGACTGCTAAGCCTCGCATTCCAT
CCCAATTACAAGAAAAATGGAAAGTTGTATGTGTCCTATACCACCAACCAAGAACGGTGGGCTATCGGGCCTCAT
GACCACATTCTTAGGGTTGTGGAATACACAGTATCCAGAAAAAATCCACACCAAGTTGATTTGAGAACAGCCAGA
GTCTTTCTTGAAGTTGCAGAACTCCACAGAAAGCATCTGGGAGGACAACTGCTCTTTGGCCCTGACGGCTTTTTG
TACATCATTCTTGGTGATGGGATGATTACACTGGATGATATGGAAGAAATGGATGGGTTAAGTGATTTCACAGGC
TCAGTGCTACGGCTGGATGTGGACACAGACATGTGCAACGTGCCTTATTCCATACCAAGGAGCAACCCACACTTC
AACAGCACCAACCAGCCCCCCGAAGTGTTTGCTCATGGGCTCCACGATCCAGGCAGATGTGCTGTGGATAGACAT
CCCACTGATATAAACATCAATTTAACGATACTGTGTTCAGACTCCAATGGAAAAAACAGATCATCAGCCAGAATT
CTACAGATAATAAAGGGGAAAGATTATGAAAGTGAGCCATCACTTTTAGAATTCAAGCCATTCAGTAATGGTCCT
TTGGTTGGTGGATTTGTATACCGGGGCTGCCAGTCAGAAAGATTGTATGGAAGCTACGTGTTTGGAGATCGTAAT
GGGAATTTCCTAACTCTCCAGCAAAGTCCTGTGACAAAGCAGTGGCAAGAAAAACCACTCTGTCTCGGCACTAGT
GGGTCCTGTAGAGGCTACTTTTCCGGTCACATCTTGGGATTTGGAGAAGATGAACTAGGTGAAGTTTACATTTTA
TCAAGCAGTAAAAGTATGACCCAGACTCACAATGGAAAACTCTACAAAATTGTAGATCCCAAAAGACCTTTAATG
CCTGAGGAATGCAGAGCCACGGTACAACCTGCACAGACACTGACTTCAGAGTGCTCCAGGCTCTGTCGAAACGGC
TACTGCACCCCCACGGGAAAGTGCTGCTGCAGTCCAGGCTGGGAGGGGGACTTCTGCAGAACTGCAAAATGTGAG
CCAGCATGTCGTCATGGAGGTGTCTGTGTTAGACCGAACAAGTGCCTCTGTAAAAAAGGATATCTTGGTCCTCAA
TGTGAACAAGTGGACAGAAACATCCGCAGAGTGACCAGGGCAGGTATTCTTGATCAGATCATTGACATGACATCT
TACTTGCTGGATCTAACAAGTTACATTGTATAGTTTCTGGGACTGTTTGAATATTCTATTCCAATGGGCATTTAT
TTTTTATCCTGTCATTAAAAAAAAAAAGACTGTTATCCTGCTACACACTCCTGTGATTTCATTCTCTTTTATTAA
TTTAAAAATAATTTCCAGAAATGTGCAGATCCTCTGTGTGTATGTCAGCATGTTTGTTCACATATGCACATACAC
ATACTCATAACCCCTATATGCGTTGTTGCATAACAGATGATTTTTTAAAATATATACTTCCTTATGCAAAGTAAT
TTACACAGAAATTCCATTGTAAATTGATAATGGATTTTTTATGTTACTAGAAGAGATTATTTGACTTCCCAGGAA
TTTTCTGTCTGTAATCACTAAAGTCAACTTTAATAGAGTTTTGAAACAGTACTGTGCAATCCGATGGATCTAATT
AAAAAAAAGGCAATATTTTTATATTAAAGTACTATACTAGGAGAGAATGTTTCAGAACTCCCTGATGAATTTCTA
AGTGAGCAACTTGATATAAAATTGTAATCTTCATTTTTGTCAGTGTATCCAGTTACAGAATGCTACACACTTACC
TTTTTATTGGCTGAGAAATCTGGTTATTTCATCTTAATCTCAAGATTGTTTTCAAGTGTTTTATAATTAAATCAT
AATAGCATATTTTAAAATCAAAAA

FIGURE 574

></usr/seqdb2/sst/DNA/Dnaseqs.min/ss.DNA139592
><subunit 1 of 1, 882 aa, 1 stop
><MW: 98428, pI: 8.89, NX(S/T): 5
MKHVTVGRNMRGCVRSCSRRQRRPQHHLEPSAGPASACAAAAVAVSVPATVPPKQLPLHG
QVNICGCPLLFFLLFQLLLLLPLPSRSRKPPTQLTLAQLQTVSSAQLYLAPRAPLRHWTH
RRVFYFCKVASLYIFLSPPPPSVSGVPYSPANSSWSCALVPLLGSGVPPHPPAPSPCCSG
QTMLKMLSFKLLLLAVALGFFEGDAKFGERNEGSGARRRRCLNGNPPKRLKRRDRRMMSQ
LELLSGGEMLCGGFYPRLSCCLRSDSPGLGRLENKIFSVTNNTECGKLLEEIKCALCSPH
SQSLFHSPEREVLERDLVLPLLCKDYCKEFFYTCRGHIPGFLQTTADEFCFYYARKDGGL
CFPDFPRKQVRGPASNYLDQMEEYDKVEEISRKHKHNCFCIQEVVSGLRQPVGALHSGDG
SQRLFILEKEGYVKILTPEGEIFKEPYLDIHKLVQSGIKGGDERGLLSLAFHPNYKKNGK
LYVSYTTNQERWAIGPHDHILRVVEYTVSRKNPHQVDLRTARVFLEVAELHRKHLGGQLL
FGPDGFLYIILGDGMITLDDMEEMDGLSDFTGSVLRLDVDTDMCNVPYSIPRSNPHFNST
NQPPEVFAHGLHDPGRCAVDRHPTDININLTILCSDSNGKNRSSARILQIIKGKDYESEP
SLLEFKPFSNGPLVGGFVYRGCQSERLYGSYVFGDRNGNFLTLQQSPVTKQWQEKPLCLG
TSGSCRGYFSGHILGFGEDELGEVYILSSSKSMTQTHNGKLYKIVDPKRPLMPEECRATV
QPAQTLTSECSRLCRNGYCTPTGKCCCSPGWEGDFCRTAKCEPACRHGGVCVRPNKCLCK
KGYLGPQCEQVDRNIRRVTRAGILDQIIDMTSYLLDLTSYIV

Important features of the protein:

Transmembrane domains:
Amino acids 63-80;186-201

N-glycosylation sites:
Amino acids 152-156;281-285;598-602;629-633;641-645

Glycosaminoglycan attachment site:
Amino acids 417-421 cAMP- and cGMP-dependent protein kinase phosphorylation site:
Amino acids 856-860

N-myristoylation sites:
Amino acids 12-18;413-419;457-463;698-695;720-726;723-729

EGF-like domain cysteine pattern signatures:
Amino acids 805-817;837-849

FIGURE 575

CGGCTCGAGAGCGGGGCAAACTGCTTGGCACCTCTTCAATAGGTGACATTCAATGATAGATCT
CTGGCTTCCTGCTCTGTTTGTTCTGGTTGCCCTGGAAAGCCTGCTGCTCAGCCCATGCCCCGG
GACTTCCTCCACCCTCACCAGGACATTCTTTCCATCTCTTGTCTCCTGTGTGCAAGTCCCTTT
CTCCTGGATTCCATGTCTTGAATGTTTCTTAATTTACTTCCTCATTTTGGCAGAGGATGTCCT
CCAGTTGTTTTCTGGGAATGCTAATATGCAAGTGAACCAGTGACCTGCAGTTCTGCCCACACA
GGGTTAATAACCAATCAGATTCTCTCTTTTCAAGATGGTTAACATAACAGACACCAAGAAAGG
GAAGAGGAGCCGACAGCAGAGGGGGAAGCTGAAAAGACGCACAAAGAATGGCCATAAAAGATA
TGAGCAACCCCAGCTTTCCAGACAGTCACTTTTCCCAGTGGTCATACCTGGTCTGGAAGATTC
CCCATCATCTCGAATAAAGCTGTTGTTGCTTTTAACTCCATGGAGAGACCGAATGGAGTGAGC
CCAGCAGGGCATGCTGGGCAAGAGAGGTCCCCCGAGTCCCAAATAAGAATTTCAACTAGTATA
AAACGAGGCAGCGAACCCACACGTGGAAGTCTGATACCGCTTGCAGAAGGGAATTGAATAGAT
GTCTCCCTATTGGTAAGGATGTGGTTTTATTGACTTGAAATAACAAAGCCCGCAAGCAACAAC
TGATCATCCGCGGGATGCTGCCACAAGGAATAATTGAGCACTCATTCAGACACAGGGGAAACC
ACTGCCTCTTTCAGTCTTTCTCCCAGATTCCAACAGTCAGTGTTACAGCATTTCACCTTGTTC
ACCTCCCTGAGAAGACGTTGCAGCTCACTCACCCCAGTGGGCACTGGGAGCCTCTGCTCAGGT
GGGAGACAGATGCCCCCCACATGCACATCTGGTGTTTATGAAGCAGATACTGGGGCTTCATAA
ACACAGAAGGGGCAGGGAAGTAGCCCCAGGGCATAGTGTGGGGCCTCCTGACTAAAAGTAGCTT
GCAAACCCCTGCCTATAACAGCCACTTCCTGGCAGTCATTGTGCCACTTAGGAGCCCTCCTCA
CCGCTCTTCCTTTAGTTCCTTCACTCTGTATAGACCCTGCCAGAGCAGCTCAGGGTGGAGCAG
CTGCAGCCATGGGACCTGCTCCAGGCAAGGCCCTATGCTACACAGTCCCTGGGGGTGAGGATT
CCAGAGGAGTCAATTCCCTACCCGCCCTTCCAGGGGATGGCCGAGATGAGCGTTCCCACAGGG
AAAGTGAAAGTTGCAAGGCTGTTGCGGAAACACCAGGGGTTCCATTTAGGTCTTGCTGCTCAT
CTCACAGAAAGCCAGTCACTGAGACAAGTATTGTCAGGGAAGAAGGCTTTATCCAGGTGCTAC
AGACAGGGTGAACAAGAGATCAGTCTCAAATCCATCATCATCAACTGACTAAAATTAGGGGTT
TATATAGCAGGGAAGAAATGTAACTACATGTGGGAAAACAGGGATTAACGAGGGGCAAGGAAG
AGGAGTTGGCCAACAGGCAGCAGGTGGTCACCTGGGGAATCATGATGGGTGAGGGGTCTGGCT
TCTCACTTTCCAGATGTGGGGATCTGGTAAATTTCAGTTTCTTGATACCGTCTGGGAGGATTG
CTGGCTGGTTTCCTGAGAAAGGAATTCAGATGACATAAATGTAAATTTCTCCTTGGGTTTCAA
GACTGAGAGGGTCAATTTCTAGGTTTATTCAAGAAAAACCATAAACATCAGTTCTATGGGACA
ATTGGGCCCATTTCAAGGCTCTGAGGATAAGGGTTAATGAGGGGACAGAGTCGCCTGGAGAAG
TTCACTGGGGCCTACAAGAAACTAGAGAGGCTTCCTGGCAAAGCTCTATGCTGTCTATCCTCT
CTTCTCTCCTTGCAGGAAGATTCCAGTATAATAGACCCGAGGTGAAAAGGCTTTTGTTCAATA
AGTAGAAAACTGAAGGGGGGTGGAGGCACATGGATTTGAACCAGAGACCGCTTGGCCTGCAG
GCAAATGCTGTACCTTCAGTTGCACCCCTCACTTGTTACAGCTGTTTCTGATAAGCACTTGTG
CAGCCCCATCAGCACCTCGATTTCTTCTTGGTGAGTCCATGGGAACAGCCCCACTGCAAACAA
CCCATTCCTGCTCTCCTCTTTCCTCTAAACCTCAACCTCCTCCTACCTGGCAGTCCACAGGCC
TACAGCTTCTCCTCAGTGGGAAAGACATCAGCTTGGAAAACCACTTGGAAAGCCAACGTTATC
CTAGAAAAGCTTTTTAAATGACCCAGCAGGACAAGTCTCCGGATGGCCTTGGCCAACCCGGTG
CTTCCCTCTTTTCTTGGTTGTAGTTCTCAGAATAACTAGAGAATGTACTGGAGTGTTGTCCT
GAGATAAGGAGGAACTGTCCTAAACCTGGACTCTGTTCCCATCACACCTAGAACAGGATGTCC
TGCAACGCTTTAGCCCAATGATCCAAGTTGCCCTTGGGGTATAAAACTTGACAGCAGAGGGCG
TTCAGGGTCCCTCAGCTGCAGTGTGAAGTGGGACACACAGGTGAGACTCCATCTGCCCTGGGC
AGGTTCCTGAGCCTTGGGGGACCAGTTCACCCTACATCCCAGGCTTCTGTTGTCCCTTGCCTG
CCTGTAAGGAATAAAGTTGCTTTGCTTA

FIGURE 576

></usr/seqdb2/sst/DNA/Dnaseqs.min/ss.DNA139608
><subunit 1 of 1, 80 aa, 1 stop
><MW: 8927, pI: 3.77, NX(S/T): 0
MIDLWLPALFVLVALESLLLSPCPGTSSTLTRTFFPSLVSCVQVPFSWIPCLECFLIYFL
ILAEDVLQLFSGNANMQVNQ

Important features of the protein:
Signal peptide:
Amino acids 1-29

Transmembrane domain:
Amino acids 47-62

N-myristoylation sites:
Amino acids 25-31

FIGURE 577

ATCGGTTAGCGCCTTGCCATGATTAATCCAGAGCTGCGGGATGGCAGAGCTGATGGCTTCATA
CATCGGATAGTTCCCAAGTTGATACAAAACTGGAAGATTGGCCTTATGTGCTTCCTGAGTATT
ATTATTACTACAGTTTGCATTATTATGATAGCCACATGGTCCAAGCATGCTAAACCTGTGGCA
TGTTCAGGGGACTGGCTTGGAGTGAGAGATAAGTGTTTCTATTTTTCTGATGATACCAGAAAT
TGGACAGCCAGTAAAATATTTTGTAGTTTGCAGAAAGCAGAACTTGCTCAGATTGATACACAA
GAAGACATGGAATTTTTGAAGAGGTACGCAGGAACTGATATGCACTGGATTGGACTAAGCAGG
AAACAAGGAGATTCTTGGAAATGGACAAATGGCACCACATTCAATGGTTGGCCATCAAACTCC
AAATGGTCTTGCAACTGGAGCCTCCGACAATGGCTTCTTCTGCTGGGACCCCTTAGATAGGCC
TCTGAGGGAGCTCTGACTGCCGTTTCCCCAAAACAATGTCCCCTGTCAGCAGGAAGCAGTTAA
ATCAGTCTTCATCCTTATCCTTAATATAACGGCAGTTAGATGTACTTCTTTAGAGGGAGTAAA
TTTATCAATTCAGAGCAATTCATCCTCCTCTTTCCATCTTTGATTCACAGTTAATAGGCTATA
AATTTTGATAATGTAGAATAAACTACAGAAAACTTCTTG

FIGURE 578

></usr/seqdb2/sst/DNA/Dnaseqs.min/ss.DNA143292
><subunit 1 of 1, 160 aa, 1 stop
><MW: 18576, pI: 9.29, NX(S/T): 3
MINPELRDGRADGFIHRIVPKLIQNWKIGLMCFLSIIITTVCIIMIATWSKHAKPVACSG
DWLGVRDKCFYFSDDTRNWTASKIFCSLQKAELAQIDTQEDMEFLKRYAGTDMHWIGLSR
KQGDSWKWTNGTTFNGWPSNSKWSCNWSLRQWLLLLGPLR

Important features of the protein:
Signal peptide:
Amino acids 1-42

N-glycosylation sites:
Amino acids 78-82;130-134;146-150

N-myristoylation site:
Amino acids 131-137

FIGURE 579

TGAAGGCCTGTGAGTGAGGAATGCCTCTCACCAGCTGTGCCTGAGCTGCAGCACTCCAGCCAC
TGCTGTCTCCTTAGCTGCTCACATATGGATACTTTCACAGTTCAGGATTCCACTGCAATGAGC
TGGTGGAGGAATAATTTCTGGATCATCTTAGCTGTGGCCATCATTGTTGTCTCTGTGGGCCTG
GGCCTCATCCTGTACTGTGTCTGTAAGTGGCAGCTTAGACGAGGCAAGAAATGGGAAATTGCC
AAGCCCCTGAAACACAAGCAAGTAGATGAAGAAAAGATGTATGAGAATGTTCTTAATGAGTCG
CCAGTTCAATTACCGCCTCTGCCACCGAGGAATTGGCCTTCTCTAGAAGACTCTTCCCCACAG
GAAGCCCCAAGTCAGCCGCCCGCTACATACTCACTGGTAAATAAAGTTAAAAATAAGAAGACT
GTTTCCATCCCAAGCTACATTGAGCCTGAAGATGACTATGACGATGTTGAAATCCCTGCAAAT
ACTGAAAAAGCATCATTTTGAAACAGCCATTTCTTCTTTTTGGCAAAACTGAAGAGGGTTCAC
ACAACTTATTTTAAAACAATCAAGAATGGTTGAACTTCAGTAGGTCTCTGGGCCCTGAAAGCC
AGTGGTGATTTTATGAAGCTCTATAAGATAAAGCACTTCCCAAACCTTAGATGAAGACACCCC
TGCGATCGGATGACTGCAGCCAGAGGAGACACATGGGTGCTCGGCTCTGAGGACTTAGAGGGG
TCAGCCTTGTGCTGTTGAGGAAACTTTCCATGGGAAGGACCACGGGGCTCCATGGCTCCCACC
TGTGGGAAACTACTCATTTCTTGGCATTCTTTCCCCCTTCATTCCCTTTGGTTTGCATGGTTC
TGAGTGATATTAAATCTCAGCATTTGGTTGTGCAAAAAAAAAA

FIGURE 580

></usr/seqdb2/sst/DNA/Dnaseqs.min/ss.DNA144844
><subunit 1 of 1, 145 aa, 1 stop
><MW: 16618, pI: 5.26, NX(S/T): 1
MDTFTVQDSTAMSWWRNNFWIILAVAIIVVSVGLGLILYCVCKWQLRRGKKWEIAKPLKH
KQVDEEKMYENVLNESPVQLPPLPPRNWPSLEDSSPQEAPSQPPATYSLVNKVKNKKTVS
IPSYIEPEDDYDDVEIPANTEKASF

Important features of the protein:
Signal peptide:
Amino acids 1-35

Tyrosine kinase phosphorylation site:
Amino acids 61-70

Amidation site:
Amino acids 48-52

FIGURE 581

GGCCGCCTCCGCGGGGCTGTGGGAAGCTTGGGCTGTCCCAGGACCGTCAGTCTCCTCCTCTGA
CCCTCCCTTTCCCCTTGTGTGTAGGGCCGCCGTCCCACCCCCACCTCGCCGGAGTCCGGGGCG
GCCCCGGTGTCCCCTCCGAGCCTGCTGCACTCCACGTCCCCCTACCAGGGCTCCAGCCCCCAG
GGAAATCTCCGACCAGGCCCGCCCAGGAGCCAGATCCAGGCTCCTGGAAGAACCATGTCCGGC
AGCTACTGGTCATGCCAGGCACACACTGCTGCCCAAGAGGAGCTGCTGTTTGAATTATCTGTG
AATGTTGGGAAGAGGAATGCCAGAGCTGCCGGCTGAAAATTACCCAACCAAGAGAAATCTGCAGG
ATGGACTTTCTGGTCCTCTTCTTGTTCTACCTGGCTTCGGTGCTGATGGGTCTTGTTCTTATC
TGCGTCTGCTCGAAAACCCATAGCTTGAAAGGCCTGGCCAGGGGAGGAGCACAGATATTTTCC
TGTATAATTCCAGAATGTCTTCAGAGAGCCGTGCATGGATTGCTTCATTACCTTTTCCATACG
AGAAACCACACCTTCATTGTCCTGCACCTGGTCTTGCAAGGGATGGTTTATACTGAGTACACC
TGGGAAGTATTTGGCTACTGTCAGGAGCTGGAGTTGTCCTTGCATTACCTTCTTCTGCCCTAT
CTGCTGCTAGGTGTAAACCTGTTTTTTTTCACCCTGACTTGTGGAACCAATCCTGGCATTATA
ACAAAAGCAAATGAATTATTATTTCTTCATGTTTATGAATTTGATGAAGTGATGTTTCCAAAG
AACGTGAGGTGCTCTACTTGTGATTTAAGGAAACCAGCTCGATCCAAGCACTGCAGTGTGTGT
AACTGGTGTGTGCACCGTTTCGACCATCACTGTGTTTGGGTGAACAACTGCATCGGGGCCTGG
AACATCAGGTACTTCCTCATCTACGTCTTGACCTTGACGGCCTCGGCTGCCACCGTCGCCATT
GTGAGCACCACTTTTCTGGTCCACTTGGTGGTGATGTCAGATTTATACCAGGAGACTTACATC
GATGACCTTGGACACCTCCATGTTATGGACACGGTCTTTCTTATTCAGTACCTGTTCCTGACT
TTTCCACGGATTGTCTTCATGCTGGGCTTTGTCGTGGTTCTGAGCTTCCTCCTGGGTGGCTAC
CTGTTGTTTGTCCTGTATCTGGCGGCCACCAACCAGACTACTAACGAGTGGTACAGAGGTGAC
TGGGCCTGGTGCCAGCGTTGTCCCCTTGTGGCCTGGCCTCCGTCAGCAGAGCCCCAAGTCCAC
CGGAACATTCACTCCCATGGGCTTCGGAGCAACCTTCAAGAGATCTTTCTACCTGCCTTTCCA
TGTCATGAGAGGAAGAAACAAGAATGACAAGTGTATGACTGCCTTTG

FIGURE 582

></usr/seqdb2/sst/DNA/Dnaseqs.min/ss.DNA144857
><subunit 1 of 1, 344 aa, 1 stop
><MW: 39787, pI: 7.44, NX(S/T): 2
MDFLVLFLFYLASVLMGLVLICVCSKTHSLKGLARGGAQIFSCIIPECLQRAVHGLLHYL
FHTRNHTFIVLHLVLQGMVYTEYTWEVFGYCQELELSLHYLLLPYLLLGVNLFFFTLTCG
TNPGIITKANELLFLHVYEFDEVMFPKNVRCSTCDLRKPARSKHCSVCNWCVHRFDHHCV
WVNNCIGAWNIRYFLIYVLTLTASAATVAIVSTTFLVHLVVMSDLYQETYIDDLGHLHVM
DTVFLIQYLFLTFPRIVFMLGFVVVLSFLLGGYLLFVLYLAATNQTTNEWYRGDWAWCQR
CPLVAWPPSAEPQVHRNIHSHGLRSNLQEIFLPAFPCHERKKQE

Important features of the protein:
Signal peptide:
Amino acids 1-29

Transmembrane domains:
Amino acids 100-116;201-217;256-275

N-glycosylation sites:
Amino acids 65-69;284-290

N-myristoylation sites:
Amino acids 32-38;77-83;120-126;322-328

Cell attachment sequence:
Amino acids 292-298

DHHC zinc finger domain:
Amino acids 140-204

FIGURE 583

CCGCGGAACTGGCAGGCGTTTCAGAGCGTCAGAGGCTGCGGATGAGCAGACTTGGAGGACTCCAGGCCAGAGACT
AGGCTGGGCGAAGAGTCGAGCGTGAAGGGGGCTCCGGGCCAGGGTGACAGGAGGCGTGCTTGAGAGGAAGAAGTT
GACGGGAAGGCCAGTGCGACGGCAAATCTCGTGAACCTTGGGGGACGAATGCTCAGGATGCGGGTCCCCGCCCTC
CTCGTCCTCCTCTTCTGCTTCAGAGGGAGAGCAGGCCCGTCGCCCCATTTCCTGCAACAGCCAGAGGACCTGGTG
GTGCTGCTGGGGGAGGAAGCCCGGCTGCCGTGTGCTCTGGGCGCCTACTGGGGGCTAGTTCAGTGGACTAAGAGTGGG
CTGGCCCTAGGGGGCCAAAGGGACCTACCAGGGTGGTCCCGGTACTGGATATCAGGGAATGCAGCCAATGGCCAG
CATGACCTCCACATTAGGCCCGTGGAGCTAGAGGATGAAGCATCATATGAATGTCAGGCTACACAAGCAGGCCTC
CGCTCCAGACCAGCCCAACTGCACGTGCTGGTCCCCCCAGAAGCCCCCCAGGTGCTGGGCGGCCCCTCTGTGTCT
CTGGTTGCTGGAGTTCCTGCGAACCTGACATGTCGGAGCCGTGGGGATGCCCGCCCTACCCCTGAATTGCTGTGG
TTCCGAGATGGGGTCCTGTTGGATGGAGCCACCTTTCATCAGACCCTGCTGAAGGAAGGGACCCCTGGGTCAGTG
GAGAGCACCTTAACCCTGACCCCTTTCAGCCATGATGATGGAGCCACCTTTGTCTGCCGGGCCCGGAGCCAGGCC
CTGCCCACAGGAAGAGACACAGCTATCACACTGAGCCTGCAGTACCCCCCAGAGGTGACTCTGTCTGCTTCGCCA
CACACTGTGCAGGAGGGAGAGAAGGTCATTTTCCTGTGCCAGGCCACAGCCCAGCCTCCTGTCACAGGCTACAGG
TGGGCAAAAGGGGGCTCTCCGGTGCTCGGGGCCCGCGGGCCAAGGTTAGAGGTCGTGGCAGACGCCTCGTTCCTG
ACTGAGCCCGTGTCCTGCGAGGTCAGCAACGCCGTGGGTAGCGCCAACCGCAGTACTGCGCTGGATGTGCTGTTT
GGGCCGATTCTGCAGGCAAAGCCGGAGCCCGTGTCCGTGGACGTGGGGGAAGACGCTTCCTTCAGCTGCGCCTGG
CGCGGGAACCCGCTTCCACGGGTAACCTGGACCCGCCGCGGTGGCGCGCAGGTGCTGGGCTCTGGAGCCACACTG
CGTCTTCCGTCGGTGGGGCCCGAGGACGCAGGCGACTATGTGTGCAGAGCTGAGGCTGGGCTATCGGGCCTGCGG
GGCGGCGCCGCGGAGGCTCGGCTGACTGTGAACGCTCCCCCAGTAGTGACCGCCCTGCACTCTGCGCCTGCCTTC
CTGAGGGGCCCTGCTCGCCTCCAGTGTCTGGTTTTCGCCTCTCCCGCCCCAGATGCCGTGGTCTGGTCTTGGGAT
GAGGGCTTCCTGGAGGCGGGGTCGCAGGGCCGGTTCCTGGTGGAGACATTCCCTGCCCCAGAGAGCCGCGGGGGA
CTGGGTCCGGGCCTGATCTCTGTGCTACACATTTCGGGGACCCAGGAGTCTGACTTTAGCAGGAGCTTTAACTGC
AGTGCCCGGAACCGGCTGGGCGAGGGAGGTGCCCAGGCCAGCCTGGGCCGTAGAGACTTGCTGCCCACTGTGCGG
ATAGTGGCCGGAGTGGCCGCTGCCACCACAACTCTCCTTATGGTCATCACTGGGGTGGCCCTCTGCTGCTGGCGC
CACAGCAAGGCCTCAGCCTCTTTCTCCGAGCAAAAGAACCTGATGCGAATCCCTGGCAGCAGCGACGGCTCCAGT
TCACGAGGTCCTGAAGAAGAGGAGACAGGCAGCCGCGAGGACCGGGGCCCCATTGTGCACACTGACCACAGTGAT
CTGGTTCTGGAGGAGGAAGGGACTCTGGAGACCAAGGACCCAACCAACGGTTACTACAAGGTCCGAGGAGTCAGT
GTGAGCCTGAGCCTTGGCGAAGCCCCTGGAGGAGGTCTCTTCCTGCCACCACCCTCCCCCCTTGGGCCCCCAGGG
ACCCCTACCTTCTATGACTTCAACCCACACCTGGGCATGGTCCCCCCCTGCAGACTTTACAGAGCCAGGGCAGGC
TATCTCACCACACCCCACCCTCGAGCTTTCACCAGCTACATCAAACCCACATCCTTTGGGCCCCCAGATCTGGCC
CCCGGGACTCCCCCCTTCCCATATGCTGCCTTCCCCACACCTAGCCACCCGCGTCTCCAGACTCACGTGTGACAT
CTTTCCAATGGAAGAGTCCTGGGATCTCCAACTTGCCATAATGGATTGTTCTGATTTCTGAGGAGCCAGGACAAG
TTGGCGACCTTACTCCTCCAAAACTGAACACAAGGGGAGGGAAAGATCATTACATTTGTCAGGAGCATTTGTATA
CAGTCAGCTCAGCCAAAGGAGATGCCCCAAGTGGGAGCAACATGGCCACCCAATATGCCCACCTATTCCCCGGTG
TAAAAGAGATTCAAGATGGCAGGTAGGCCCCTTTGAGGAGAGATGGGGACAGGGCAGTGGGTGTTGGGAGTTTGGG
GCCGGGATGGAAGTTGTTTCTAGCCACTGAAAGAAGATATTTCAAGATGACCATCTGCATTGAGAGGAAAGGTAG
CATAGGATAGATGAAGATGAAGAGCATACCAGGCCCCACCCTGGCTCTCCCTGAGGGGAACTTTGCTCGGCCAAT
GGAAATGCAGCCAAGATGGCCATATACTCCCTAGGAACCCAAAATGGCCACCATCTTGATTTTACTTTCCTTAAA
GACTCAGAAAGACTTGGACCCAAGGAGTGGGGATACAGTGAGAATTACCACTGTTGGGGCAAAATATTGGGATAA
AAATATTTATGTTTAATAATAAAAAAAAGTCAAAGAGAAAAAAAA

FIGURE 584

></usr/seqdb2/sst/DNA/Dnaseqs.min/ss.DNA145841
><subunit 1 of 1, 708 aa, 1 stop
><MW: 75093, pI: 6.65, NX(S/T): 3
MLRMRVPALLVLLFCFRGRAGPSPHFLQQPEDLVVLLGEEARLPCALGAYWGLVQWTKSG
LALGGQRDLPGWSRYWISGNAANGQHDLHIRPVELEDEASYECQATQAGLRSRPAQLHVL
VPPEAPQVLGGPSVSLVAGVPANLTCRSRGDARPTPELLWFRDGVLLDGATFHQTLLKEG
TPGSVESTLTLTPFSHDDGATFVCRARSQALPTGRDTAITLSLQYPPEVTLSASPHTVQE
GEKVIFLCQATAQPPVTGYRWAKGGSPVLGARGPRLEVVADASFLTEPVSCEVSNAVGSA
NRSTALDVLFGPILQAKPEPVSVDVGEDASFSCAWRGNPLPRVTWTRRGGAQVLGSGATL
RLPSVGPEDAGDYVCRAEAGLSGLRGGAAEARLTVNAPPVVTALHSAPAFLRGPARLQCL
VFASPAPDAVVWSWDEGFLEAGSQGRFLVETFPAPESRGGLGPGLISVLHISGTQESDFS
RSFNCSARNRLGEGGAQASLGRRDLLPTVRIVAGVAAATTTLLMVITGVALCCWRHSKAS
ASFSEQKNLMRIPGSSDGSSSRGPEEEETGSREDRGPIVHTDHSDLVLEEEGTLETKDPT
NGYYKVRGVSVSLSLGEAPGGGLFLPPPSPLGPPGTPTFYDFNPHLGMVPPCRLYRARAG
YLTTPHPRAFTSYIKPTSFGPPDLAPGTPPFPYAAFPTPSHPRLQTHV

Important features of the protein:
Signal peptide:
Amino acids 1-20

Transmembrane domain:
Amino acids 511-531

N-glycosylation sites:
Amino acids 143-147;301-305;484-488

N-myristoylation sites:
Amino acids 48-54;60-66;79-85;139-145;180-186;183-189;355-361;383-389;
387-393;460-466;473-479;494-500;495-501;514-520;528-534;
554-560;592-598;608-614

Amidation site:
Amino acids 500-504

Cell attachment sequence:
Amino acids 149-152

Multicopper oxidases signature 1:
Amino acids 445-466

Immunoglobulin domain:
Amino acids 326-377

FIGURE 585

GCCCGCCTGAGGAAGCCGTGTGCCTGGGATGCCAAGAGCCAGAGAATGGATCTTCTCCGAGTG
GGGACATTGCTGACAATCCCGGCTTCCCGAGGCGGCTAAGAACAGGCAGTTTGTGTCGGCTGG
CTGCAGATACCCAGAGGCACAAAGAGACCGAAGCCACCCGGAGGGACCCACGGACGGACAGAT
GGTAGGCGCGAACCCGAGAGGACCGGCGGAGGCTGAGCACCGAGAGCCGCCAAGGAAGAGAAA
CTAACCACAGCCAAGTTACCCCGCCGGCTTTCCTTCGCTGCGCTAAGGAATGAAACCCTTCCA
GCTCGATCTGCTCTTCGTCTGCTTCTTCCTCTTCAGTCAAGAGCTGGGCCTCCAGAAGAGAGG
ATGCTGTCTGGTGCTGGGCTACATGGCCAAGGACAAGTTTCGGAGAATGAATGAAGGCCAAGT
CTATTCCTTCAGCCAGCAGCCCCAGGACCAGGTGGTGGTGTCGGGACAGCCAGTGACGCTACT
TTGCGCCATCCCCGAATACGATGGCTTCGTTCTGTGGATCAAGGACGGCTTGGCTCTGGGTGT
GGGCAGGGACCTCTCAAGTTACCCACAGTACCTGGTGGTAGGGAACCACCTGTCAGGGGAGCA
CCACCTGAAGATCCTGAGGGCAGAGCTGCAAGACGATGCGGTGTACGAGTGCCAGGCCATCCA
GGCCGCCATCCGCTCCCGCCCCGCACGCCTCACAGTCCTGGTGCCGCCTGATGACCCCGTCAT
CCTGGGGGGCCCTGTGATCAGCCTGCGTGCGGGGGACCCTCTCAACCTCACCTGCCACGCAGA
CAATGCCAAGCCTGCAGCCTCCATCATCTGGTTGCGAAAGGGAGAGGTCATCAATGGGGCCAC
CTACTCCAAGACCCTGCTTCGGGACGGCAAGCGGGAGAGCATCGTCAGCACCCTCTTCATCTC
CCCTGGTGACGTGGAGAATGGCCAGAGCATCGTGTGTCGTGCCACCAACAAAGCCATCCCCGG
AGGAAAGGAGACGTCGGTCACCATTGACATCCAGCACCCTCCACTGGTCAACCTCTCGGTGGA
GCCACAGCCAGTGCTGGAGGACAACGTCGTCACTTTCCACTGCTCTGCAAAGGCCAACCCAGC
TGTCACCCAGTACAGGTGGGCCAAGCGGGGCCAGATCATCAAGGAGGCATCTGGAGAGGTGTA
CAGGACCACAGTGGACTACACGTACTTCTCAGAGCCCGTCTCCTGTGAGGTGACCAACGCCCTG
GGCAGCACCAACCTCAGCCGCACGGTTGACGTCTACTTTGGGCCCCGGATGACCACAGAACCC
CAATCCTTGCTCGTGGATCTGGGCTCTGATGCCATCTTCAGCTGCGCCTGGACCGGCAACCCA
TCCCTGACCATCGTCTGGATGAAGCGGGGCTCCGGAGTGGTCCTGAGCAATGAGAAGACCCTG
ACCCTCAAATCCGTGCGCCAGGAGGACGCGGGCAAGTACGTGTGCCGGGCTGTGGTGCCCCGT
GTGGGAGCCGGGGAGAGAGAGGTGACCCTGACCGTCAATGGACCCCCCATCATCTCCAGCACC
CAGACCCAGCACGCCCTCCACGGCGAGAAGGGCCAGATCAAGTGCTTCATCCGGAGCACGCCG
CCGCCGGACCGCATCGCCTGGTCCTGGAAGGAGAACGTTCTGGAGTCGGGCACATCGGGGCGC
TATACGGTGGAGACCATCAGCACCGAGGAGGGCGTCATCTCCACCCTGACCATCAGCAACATC
GTGCGGGCCGACTTCCAGACCATCTACAACTGCACGGCCTGGAACAGCTTCGGCTCCGACACT
GAGATCATCCGGCTCAAGGAGCAAGGTTCGGAAATGAAGTCGGGAGCCGGGCTGGAAGCAGAG
TCTGTGCCGATGGCCGTCATCATTGGGGTGGCCGTAGGAGCTGGTGTGGCCTTCCTCGTCCTT
ATGGCAACCATCGTGGCGTTCTGCTGTGCCCGTTCCCAGAGAAGTACGGGAGGGAGATCCGGG
ATCTCAGGGAGGGGGACAGAGAAAAAGGCCAGGCTTAGGCTGCCCCGGAGAGCAAGTAAGCAG
GAGTGCAATGAACAGGGGTCCTAACAGTGCTGTGAGCTCCTGGGGCAGGGAGTGGGTCTGATG
CATCGGTGTATGTGAGCCTGGGCAACATGGCGCCTGGCAGAGTGGGCGCTAGGCTGAGGTTGA
CCTGGACTAGACTGAACTTCATCTGCAGGGCAGCCAGCATTTTGGATTGAACACATAGCTCTT
TCAGTCAGGAACTGTACAGAAAGATAGGGGGAAAAGCGGTTTGTGGTTTGATCCTTGCTCTAC
AAGAGCTGTTAGTCTAGAGAGACCCCATCTCTACAACAAAATAAAAATAAAGAGCTGCTAGTC
TCACCAGAAAAGCAGGTCACTCACACAGCTGTGGGGGAGTGGGTGGGGAAGCAATAAAGGAAT
TGCTTTGAGAAAACTTAA

FIGURE 586

></usr/seqdb2/sst/DNA/Dnaseqs.min/ss.DNA148004
><subunit 1 of 1, 600 aa, 1 stop
><MW: 65308, pI: 8.35, NX(S/T): 5
MKPFQLDLLFVCFFLFSQELGLQKRGCCLVLGYMAKDKFRRMNEGQVYSFSQQPQDQVVV
SGQPVTLLCAIPEYDGFVLWIKDGLALGVGRDLSSYPQYLVVGNHLSGEHHLKILRAELQ
DDAVYECQAIQAAIRSRPARLTVLVPPDDPVILGGPVISLRAGDPLNLTCHADNAKPAAS
IIWLRKGEVINGATYSKTLLRDGKRESIVSTLFISPGDVENGQSIVCRATNKAIPGGKET
SVTIDIQHPPLVNLSVEPQPVLEDNVVTFHCSAKANPAVTQYRWAKRGQIIKEASGEVYR
TTVDYTYFSEPVSCEVTNALGSTNLSRTVDVYFGPRMTTEPQSLLVDLGSDAIFSCAWTG
NPSLTIVWMKRGSGVVLSNEKTLTLKSVRQEDAGKYVCRAVVPRVGAGEREVTLTVNGPP
IISSTQTQHALHGEKGQIKCFIRSTPPPDRIAWSWKENVLESGTSGRYTVETISTEEGVI
STLTISNIVRADFQTIYNCTAWNSFGSDTEIIRLKEQGSEMKSGAGLEAESVPMAVIIGV
AVGAGVAFLVLMATIVAFCCARSQRSTGGRSGISGRGTEKKARLRLPRRASKQECNEQGS

Important features of the protein:
Signal peptide:
Amino acids 1-17

Transmembrane domain:
Amino acids 534-555

N-glycosylation sites:
Amino acids 167-171;253-257;324-328;498-502

Glycosaminoglycan attachment sites:
Amino acids 523-527;574-578 cAMP- and cGMP-dependent protein kinase phosphorylation sites:
Amino acids 204-208;370-374;588-592

Tyrosine kinase phosphorylation sites:
Amino acids 40-49;300-308;389-397

N-myristoylation sites:
Amino acids 45-51;62-68;84-90;103-109;192-198;236-242;
374-380;436-442;478-484;539-545;543-549;
568-574

Amidation site:
Amino acids 202-206

Leucine zipper pattern:
Amino acids 8-30

FIGURE 587

CAAAAAAGGAGCATGTCTTCATCCATGAGAGGCCTCGAAAAATCAATGGTATTTGCATTTCTC
CCAAGAAGGTTGCTTGCCAAAACCTTTCGGCCATTTTCTGCTTTCAGAGTGAGACAAAGTTCA
AAATGACAGTCTGTCAGCTCATTGAAGGCACTAGATACCCTGCCTGCAGGTACCACTATTCCC
CCACAGAGGGGTTTGTTCTTGTCACTTGTGATGACTTGAGGCCAGATAGTTTCCTTGGCTATG
TTAAATAACTCAAGATCAGCTACCGAGTCTGAGATCTCTTCTCTCATGGCATTGGAGCTGGCT
GTGCCTGAGGCAGACCTGGACCGTGGACATGGGGCAATGCCTTGAGCGGAAGGGGAAGCCACT
GAATTTTGGGTGTCACCAGGTAAACAGAGCCCTCAGCATCTGAATAGAAACTGAACAGGAACA
GAAGAGATTACACTACATCTGAGATGGAGACCTTTCCTCTGCTGCTGCTCAGCCTGGGCCTGG
TTCTTGCAGAAGCATCAGAAAGCACAATGAAGATAATTAAAGAAGAATTTACAGACGAAGAGA
TGCAATATGACATGGCAAAAAGTGGCCAAGAAAAACAGACCATTGAGATATTAATGAACCCGA
TCCTGTTAGTTAAAAATACCAGCCTCAGCATGTCCAAGGATGATATGTCTTCCACATTACTGA
CATTCAGAAGTTTACATTATAATGACCCCAAGGGAAACAGTTCGGGTAATGACAAAGAGTGTT
GCAATGACATGACAGTCTGGAGAAAAGTTTCAGAAGCAAACGGATCGTGCAAGTGGAGCAATA
ACTTCATCCGCAGCTCCACAGAAGTGATGCGCAGGGTCCACAGGGCCCCCAGCTGCAAGTTTGTA
CAGAATCCTGGCATAAGCTGCTGTGAGAGCCTAGAACTGGAAAATACAGTGTGCCAGTTCACT
ACAGGCAAACAATTCCCCAGGTGCCAATACCATAGTGTTACCTCATTAGAGAAGATATTGACA
GTGCTGACAGGTCATTCTCTGATGAGCTGGTTAGTTTGTGGCTCTAAGTTGTAAATCCCACAG
AGCTTTAGGACTAGGGTCTTACTAAAGAAGGACCTCTTCTTGTTCATTCTTGTTTAAACCTTT
CCTTAATATCTACTCTTTAGCACTATAGTGAACTCCTGATTATTTATTCTAACTGGAGGAGTG
AAAAATCCAAAATTGTGGATAATTCAATTAAAAGTTATGACTGATACCG

FIGURE 588

></usr/seqdb2/sst/DNA/Dnaseqs.min/ss.DNA149893
><subunit 1 of 1, 199 aa, 1 stop
><MW: 22427, pI: 6.46, NX(S/T): 3
METFPLLLLSLGLVLAEASESTMKIIKEEFTDEEMQYDMAKSGQEKQTIEILMNPILLVK
NTSLSMSKDDMSSTLLTFRSLHYNDPKGNSSGNDKECCNDMTVWRKVSEANGSCKWSNNF
IRSSTEVMRRVHRAPSCKFVQNPGISCCESLELENTVCQFTTGKQFPRCQYHSVTSLEKI
LTVLTGHSLMSWLVCGSKL

Important features of the protein:
Signal peptide:
Amino acids 1-16

N-glycosylation sites:
Amino acids 61-65;89-93;111-115 cAMP- and cGMP-dependent protein kinase phosphorylation site:
Amino acids 105-109

N-myristoylation sites:
Amino acids 12-18;88-94;144-150

Microbodies C-terminal targeting signal:
Amino acids 197-201

FIGURE 589

CAGTCCTGCCGGGACGGTGAGCGCATTCAGCACCCTGGACAGCACCGCGGTTGCGCTGCCTCC
AGGGCGGCCCCGGGCTGCTCCTGCTCCGCAGAGCTACGCCCTCCCCCCGGGTGCCCCGGACCC
TGCACTTGCCGCCGCTTTCCTCGCGCTGCTCTGGACCTTGCTAGCCGGCTCTGCACCTCCCAG
AAGCCGTGGGCGCGCCGCTCAGCTGCTCCATCGCCTCACTTTCCCAGGCTCGCGCCCGAAGCA
GAGCCATGAGAACCCCAGGGTGCCTGGCGAGCCGCTAGCGCCATGGGCCCCGGCGAGGCGCTG
CTGGCGGGTCTCCTGGTGATGGTACTGGCCGTGGCGCTGCTATCCAACGCACTGGTGCTGCTT
TGTTGCGCCTACAGCGCTGAGCTCCGCACTCGAGCCTCAGGCGTCCTCCTGGTGAATCTGTCT
CTGGGCCACCTGCTGCTGGCGGCGCTGGACATGCCCTTCACGCTGCTCGGTGTGATGCGCGGG
CGGACACCGTCGGCGCCCGGCGCATGCCAAGTCATTGGCTTCCTGGACACCTTCCTGGCGTCC
AACGCGGCGCTGAGCGTGGCGGCGCTGAGCGCAGACCAGTGGCTGGCAGTGGGCTTCCCACTG
CGCTACGCCGGACGCCTGCGACCGCGCTATGCCGGCCTGCTGCTGGGCTGTGCCTGGGGACAG
TCGCTGGCCTTCTCAGGCGCTGCACTTGGCTGCTCGTGGCTTGGCTACAGCAGCGCCTTCGCG
TCCTGTTCGCTGCGCCTGCCGCCCGAGCCTGAGCGTCCGCGCTTCGCAGCCTTCACCGCCACG
CTCCATGCCGTGGGCTTCGTGCTGCCGCTGGCGGTGCTCTGCCTCACCTCGCTCCAGGTGCAC
CGGGTGGCACGCAGACACTGCCAGCGCATGGACACCGTCACCATGAAGGCGCTCGCGCTGCTC
GCCGACCTGCACCCCAGTGTGCGGCAGCGCTGCCTCATCCAGCAGAAGCGGCGCCGCCACCGC
GCCACCAGGAAGATTGGCATTGCTATTGCGACCTTCCTCATCTGCTTTGCCCCGTATGTCATG
ACCAGGCTGGCGGAGCTCGTGCCCTTCGTCACCGTGAACGCCCAGTGGGGCATCCTCAGCAAG
TGCCTGACCTACAGCAAGGCGGTGGCCGACCCGTTCACGTACTCTCTGCTCCGCCGGCCGTTC
CGCCAAGTCCTGGCCGGCATGGTGCACCGGCTGCTGAAGAGAACCCCGCGCCCAGCATCCACC
CATGACAGCTCTCTGGATGTGGCCGGCATGGTGCACCAGCTGCTGAAGAGAACCCCGCGCCCA
GCGTCCACCCACAACGGCTCTGTGGACACAGAGAATGATTCCTGCCTGCAGCAGACACACTGA
GGGCCTGGCAGGGCTCATCGCCCCCACCTTCTAAGAAGCCCTGTGGAAAGGGCACTGGCCCTG
CCACAGAGATGCCACTGGGGACCCCCAGACACCAGTGGCTTGACTTTGAGCTAAGGCTGAG

FIGURE 590

></usr/seqdb2/sst/DNA/Dnaseqs.min/ss.DNA149930
><subunit 1 of 1, 363 aa, 1 stop
><MW: 39332, pI: 10.42, NX(S/T): 3
MGPGEALLAGLLVMVLAVALLSNALVLLCCAYSAELRTRASGVLLVNLSLGHLLLAALDM
PFTLLGVMRGRTPSAPGACQVIGFLDTFLASNAALSVAALSADQWLAVGFPLRYAGRLRP
RYAGLLLGCAWGQSLAFSGAALGCSWLGYSSAFASCSLRLPPEPERPRFAAFTATLHAVG
FVLPLAVLCLTSLQVHRVARRHCQRMDTVTMKALALLADLHPSVRQRCLIQQKRRRHRAT
RKIGIAIATFLICFAPYVMTRLAELVPFVTVNAQWGILSKCLTYSKAVADPFTYSLLRRP
FRQVLAGMVHRLLKRTPRPASTHDSSLDVAGMVHQLLKRTPRPASTHNGSVDTENDSCLQ
QTH

Important features of the protein:
Signal peptide:
Amino acids 1-24

Transmembrane domains:
Amino acids 46-60;85-103;130-150;175-192;246-264

N-glycosylation sites:
Amino acids 47-51;348-352;355-359

Tyrosine kinase phosphorylation site:
Amino acids 286-295

N-myristoylation sites:
Amino acids 66-72;124-130;128-134;132-138;139-145;244-250;
349-355

G-protein coupled receptor proteins:
Amino acids 72-112

7 transmembrane receptor (rhodopsin family):
Amino acids 22-294

FIGURE 591

AACATGGCTGCGGCGCCTGGGCTGCTCGTCTGGCTGCTCGTGCTCCGGCTGCCCTGGCGGGTG
CCGGGCCAGCTGGACCCCAGCACTGGCCGGCGGTTCTCGGAGCACAAACTCTGCGCGGACGAC
GAATGCAGCATGATGTACCGCGGTGAGGCTCTTGAAGATTTCACAGGCCCGGATTGTCGTTTT
GTGAATTTTAAAAAAGGTGATCCTGTATATGTTTACTATAAACTGGCAAGAGGATGGCCTGAA
GTTTGGGCTGGAAGTGTTGGACGCACTTTTGGATATTTTCCAAAAGATTTAATCCAGGTAGTT
CATGAATATACCAAAGAAGAGCTACAAGTTCCAACAGATGAGACGGATTTTGTTTGTTTTGAT
GGAGGAAGAGATGATTTTCATAATTATAATGTAGAAGAACTTTTAGGGTTTTTGGAACTGTAC
AATTCTGCAGCTACAGATTCTGAGAAAGCTGTAGAAAAAACTTTACAGGATATGGAAAAAAAC
CCTGAATTATCTAAGGAAAGGGAACCTGAACCTGAACCAGTAGAAGCCAACTCAGAGGAAAGT
GATAGTGTATTCTCAGAAAACACTGAGGATCTTCAGGAACAGTTTACAACTCAGAAGCACCAC
TCCCATGCAAACAGCCAAGCAAATCATGCTCAGGGAGAGCAGGCTTCATTTGAATCTTTTGAA
GAAATGCTGCAAGATAAACTAAAAGTGCCAGAAAGTGAAAACAACAAAACCAGCAATAGTTCT
CAGGTCTCAAATGAACAGGATAAGATTGATGCCTATAAACTTTTGAAAAAAGAAATGACTCTA
GACTTGAAAACCAAATTTGGCTCAACAGCTGATGCACTTGTATCTGATGATGAGACAACCAGA
CTCGTTACTTCATTAGAAGATGATTTTGATGAGGAATTGGATACTGAGTATTATGCAGTTGGA
AAGGAAGATGAGGAGAACCAAGAAGACTTTGATGAGTTGCCATTACTTACCTTTACAGATGGG
GAAGATATGAAAACTCCAGCAAAGTCTGGCGTTGAGAAATATCCAACAGATAAAGAGCAGAAT
TCAAATGAAGAGGACAAGGTTCAGCTAACTGTGCCCCCTGGCATCAAAAATGATGATAAAAAT
ATACTAACAACCTGGGGGGACACTATCTTCTCTATTGTCACAGGAGGTGAAGAAACAAGAGAT
ACGATGGATTTAGAGAGCTCTAGTTCAGAGGAAGAAAAAGAAGATGATGATGATGCATTAGTC
CCAGATAGCAAACAGGGGAAACCACAGTCAGCAACAGATTATAGTGACCCTGACAATGTAGAT
GATGGTCTTTTTATTGTAGACATTCCTAAAACAAATAATGACAAAGAAGTAAACGCAGAACAT
CACATTAAAGGAAAAGGGAGGGGAGTTCAGGAATCCAAGAGGGGCCTGGTACAAGATGAGACA
GAATTAGAGGATGAAAATCAAGAAGGCTTTAAAACAGAGCCCATAAAACTATGACCTCTGAGG
TTTCATTGGAAAGAAAGTGTACTGTGCATTATCCATTACAGTAAAGGATTTCATTGGCTTCAA
AATCCAAAAGTTTATTTTAAAAGGTTTGTTGTTAGAACTAAGCTGCCTTGGCAGTGTGCATTT
TTGAGCCAAACAATTCAAAAATGTCATTTCTTCCCTAAATAAAAATCACCTTTTAAGCTAGAG
CGTCCTTACAACTTTGAAATGTGCAATAAAGAATACCTGTGTTTTAGCTAATGTAGCATATGT
AATTGCAAAATGATTTAGAATGTCATGAAAAATATGAACATTTCCTGTGGAAATGCTTTAAGA
ACATGTATTTCCATTATCCTATTTTTAGTGTACACCAGCTGAATACGGAGCAATGGTGTTTAT
AAGCGTTTTTTTAAACTATCTGGTCACAAAGACTGTTACGCTAAAAATGTTTACTAAAAGATC
ACTAAACTATCTCCCCTCTTGCTGAAGTTCTTTGTAGTAATAGCTCATAAAAATTTGTTTATT
AATATTTAAAAAAAAAAAAAAA

FIGURE 592

></usr/seqdb2/sst/DNA/Dnaseqs.min/ss.DNA150157
><subunit 1 of 1, 499 aa, 1 stop
><MW: 56471, pI: 4.31, NX(S/T): 2
MAAAPGLLVWLLVLRLPWRVPGQLDPSTGRRFSEHKLCADDECSMMYRGEALEDFTGPDC
RFVNFKKGDPVYVYYKLARGWPEVWAGSVGRTFGYFPKDLIQVVHEYTKEELQVPTDETD
FVCFDGGRDDFHNYNVEELLGFLELYNSAATDSEKAVEKTLQDMEKNPELSKEREPEPEP
VEANSEESDSVFSENTEDLQEQFTTQKHHSHANSQANHAQGEQASFESFEEMLQDKLKVP
ESENNKTSNSSQVSNEQDKIDAYKLLKKEMTLDLKTKFGSTADALVSDDETTRLVTSLED
DFDEELDTEYYAVGKEDEENQEDFDELPLLTFTDGEDMKTPAKSGVEKYPTDKEQNSNEE
DKVQLTVPPGIKNDDKNILTTWGDTIFSIVTGGEETRDTMDLESSSSEEEKEDDDDALVP
DSKQGKPQSATDYSDPDNVDDGLFIVDIPKTNNDKEVNAEHHIKGKGRGVQESKRGLVQD
ETELEDENQEGFKTEPIKL

Important features of the protein:
Signal peptide:
Amino acids 1-22

N-glycosylation sites:
Amino acids 245-249;249-253 cAMP- and cGMP-dependent protein kinase phosphorylation site:
Amino acids 30-34

Tyrosine kinase phosphorylation site:
Amino acids 66-72

N-myristoylation sites:
Amino acids 392-398;469-475

Amidation site:
Amino acids 28-32

Aminoacyl-transfer RNA synthetases class-II signature 1:
Amino acids 47-70

FIGURE 593

GGGCCAGTAGAGTGTGTCTGGGTCAGCTGAGTGACTACATCAAAGCTCCCAGCCTTGAAAAAC
ACATGCTGTTCCCAGGCCTCAAGATATTGAAACATTAATTAGATAATTTAAAGTAGCGTTTTC
TTCTACAATGTCTGAAGAAGTGACCTACGCGACACTCACATTTCAGGATTCTGCTGGAGCAAG
GAATAACCGAGATGGAAATAACCTAAGAAAAAGAGGGCATCCAGCTCCATCTCCCATTTGGCG
TCATGCTGCTCTGGGTCTGGTAACTCTTTGCCTGATGTTGCTGATTGGGCTGGTGACGTTGGG
GATGATGTTTTTGCAGATATCTAATGACATTAACTCAGATTCAGAGAAATTGAGTCAACTTCA
GAAAACCATCCAACAGCAGCAGGATAACTTATCCCAGCAACTGGGCAACTCCAACAACTTGTC
CATGGAGGAGGAATTTCTCAAGTCACAGATCTCCAGTCTACTGAAGAGGCAGGAACAAATGGC
CATCAAACTGTGCCAAGAGCTAATCATTCATACTTCAGACCACAGATGTAATCCATGTCCTAA
GATGTGGCAATGGTACCAAAATAGTTGCTACTATTTTACAACAAATGAGGAGAAAACCTGGGC
TAACAGTAGAAAGGACTGCATAGACAAGAACTCCACCCTAGTGAAGATAGACAGTTTGGAAGA
AAAGGATTTTCTTATGTCACAGCCATTACTCATGTTTTCGTTCTTTTGGCTGGGATTATCATG
GGACTCCTCTGGCAGAAGTTGGTTCTGGGAAGATGGCTCTGTTCCCTCTCCATCCTTGTACGT
CTCTAACTATTGAGGGTAAACACAAGCTTTCCATGGAATCCTGGGAAAATTAATAATGATTGT
GAGAATTATAAATACAGACATAAAAAGAGGAGTACAACATACTGAGAAAAGAGCTCCAGTAAC
AAATATTGAAAGGAGATTTAGTACTAAAGAACTTGACCAGATCAATGGATCCAAAGGATGTGC
TTATTTTCAAAAAGGAAATATTTATATTTCTCGCTGTAGTGCTGAAATTTTTTGGATTTGCGA
GAAGACAGCTGCCCCAGTGAAGACTGAGGATTTGGATTAGTATGCTTCTTCCAAATTCTCCAA
GAAGTAAGAGACTTGTGAGTAAGCTCATATGAGGAAAGAGGAAACTACGGTACCAGAGCAAGG
GCGAATTCTGCA

FIGURE 594

></usr/seqdb2/sst/DNA/Dnaseqs.min/ss.DNA150163
><subunit 1 of 1, 232 aa, 1 stop
><MW: 26754, pI: 5.80, NX(S/T): 3
MSEEVTYATLTFQDSAGARNNRDGNNLRKRGHPAPSPIWRHAALGLVTLCLMLLIGLVTL
GMMFLQISNDINSDSEKLSQLQKTIQQQQDNLSQQLGNSNNLSMEEEFLKSQISSLLKRQ
EQMAIKLCQELIIHTSDHRCNPCPKMWQWYQNSCYYFTTNEEKTWANSRKDCIDKNSTLV
KIDSLEEKDFLMSQPLLMFSFFWLGLSWDSSGRSWFWEDGSVPSPSLYVSNY

Important features of the protein:
Transmembrane domain:
Amino acids 42-62

N-glycosylation sites:
Amino acids 91-95;101-105;176-180

N-myristoylation sites:
Amino acids 17-23;97-103

FIGURE 595

CGGACGCGTGGGGAAGAGGAGGAGGAGGAAGAAGACGTGGACAAGGACCCCCATCCTACCCAG
AACACCTGCCTGCGCTGCCGCCACTTCTCTTTAAGGGAGAGGAAAAGAGAGCCTAGGAGAACC
ATGGGGGGCTGCGAAGTCCGGGAATTTCTTTTGCAATTTGGTTTCTTCTTGCCTATGCTGACA
GCGTGGCCAGGCGACTGCAGTCACGTCTCCAACAACCAAGTTGTGTTGCTTGATACAACAACT
GTACTGGGAGAGCTAGGATGGAAAACATATCCATTAAATGGGTGGGATGCCATCACTGAAATG
GATGAACATAATAGGCCCATTCACACATACCAGGTATGTAATGTAATGGAACCAAACCAAAAC
AACTGGCTTCGTACAAACTGGATCTCCCGTGATGCAGCTCAGAAAATTTATGTGGAAATGAAA
TTCACACTAAGGGATTGTAACAGCATCCCATGGGTCTTGGGGACTTGCAAAGAAACATTTAAT
CTGTTTTATATGGAATCAGATGAGTCCCACGGAATTAAATTCAAGCCAAACCAGTATACAAAG
ATCGACACAATTGCTGCTGATGAGAGTTTTACCCAGATGGATTTGGGTGATCGCATCCTCAAA
CTCAACACTGAAATTCGTGAGGTGGGGCCTATAGAAAGGAAAGGATTTTATCTGGCTTTTCAA
GACATTGGGGCGTGCATTGCCCTGGTTTCAGTCCGTGTTTTCTACAAGAAATGCCCCTTCACT
GTTCGTAACTTGGCCATGTTTCCTGATACCATTCCAAGGGTTGATTCCTCCTCTTTGGTTGAA
GTACGGGGTTCTTGTGTGAAGAGTGCTGAAGAGCGTGACACTCCTAAACTGTATTGTGGAGCT
GATGGAGATTGGCTGGTTCCTCTTGGAAGGTGCATCTGCAGTACAGGATATGAAGAAATTGAG
GGTTCTTGCCATGGAGCCTCCAAAGGCCGCTGCTTCTAGTTGGCCATCTTGGCCCCACCCCGA
AACAGTAACCTTTGAAGAATAAAAGAAAAAGCAAAAGAGTAGCATTACTAAAATATTAAACGG
TTACATTTACAAAAAAAAAAAAAAAAAAAAAAAAAA

FIGURE 596

></usr/seqdb2/sst/DNA/Dnaseqs.min/ss.DNA153579
><subunit 1 of 1, 285 aa, 1 stop
><MW: 32368, pI: 5.32, NX(S/T): 0
MGGCEVREFLLQFGFFLPMLTAWPGDCSHVSNNQVVLLDTTTVLGELGWKTYPLNGWDAI
TEMDEHNRPIHTYQVCNVMEPNQNNWLRTNWISRDAAQKIYVEMKFTLRDCNSIPWVLGT
CKETFNLFYMESDESHGIKFKPNQYTKIDTIAADESFTQMDLGDRILKLNTEIREVGPIE
RKGFYLAFQDIGACIALVSVRVFYKKCPFTVRNLAMFPDTIPRVDSSSLVEVRGSCVKSA
EERDTPKLYCGADGDWLVPLGRCICSTGYEEIEGSCHGASKGRCF

Important features of the protein:
Signal peptide:
Amino acids 1-22

N-myristoylation sites:
Amino acids 192-198;274-280;278-284

Receptor tyrosine kinase class V signature 1:
Amino acids 192-209

Ephrin receptor ligand binding domain:
Amino acids 34-207

FIGURE 597

ACACTGGCCAAACAAAAACGAAAGCACTCCGTGCTGGAAGTAGGAGGAGAGTCAGGACTCCCA
GGACAGAGAGTGCACAAACTACCCAGCACAGCCCCCTCCGCCCCCTCTGGAGGCTGAAGAGGG
ATTCCAGCCCCTGCCACCCACAGACACGGGCTGACTGGGGTGTCTGCCCCCCTTGGGGGGGGG
CAGCACAGGGCCTCAGGCCTGGGTGCCACCTGGCACCTAGAAGATGCCTGTGCCCTGGTTCTT
GCTGTCCTTGGCACTGGGCCGAAGCCCAGTGGTCCTTTCTCTGGAGAGGCTTGTGGGGCCTCA
GGACGCTACCCACTGCTCTCCGGGCCTCTCCTGCCGCCTCTGGGACAGTGACATACTCTGCCT
GCCTGGGGACATCGTGCCTGCTCCGGGCCCCGTGCTGGCGCCTACGCACCTGCAGACAGAGCT
GGTGCTGAGGTGCCAGAAGGAGACCGACTGTGACCTCTGTCTGCGTGTGGCTGTCCACTTGGC
CGTGCATGGGCACTGGGAAGAGCCTGAAGATGAGGAAAAGTTTGGAGGAGCAGCTGACTCAGG
GGTGGAGGAGCCTAGGAATGCCTCTCTCCAGGCCCAAGTCGTGCTCTCCTTCCAGGCCTACCC
TACTGCCCGCTGCGTCCTGCTGGAGGTGCAAGTGCCTGCTGCCCTTGTGCAGTTTGGTCAGTC
TGTGGGCTCTGTGGTATATGACTGCTTCGAGGCTGCCCTAGGGAGTGAGGTACGAATCTGGTC
CTATACTCAGCCCAGGTACGAGAAGGAACTCAACCACACACAGCAGCTGCCTGCCCTGCCCTG
GCTCAACGTGTCAGCAGATGGTGACAACGTGCATCTGGTTCTGAATGTCTCTGAGGAGCAGCA
CTTCGGCCTCTCCCTGTACTGGAATCAGGTCCAGGGCCCCCCAAAACCCCGGTGGCACAAAAA
CCTGACTGGACCGCAGATCATTACCTTGAACCACACAGACCTGGTTCCCTGCCTCTGTATTCA
GGTGTGGCCTCTGGAACCTGACTCCGTTAGGACGAACATCTGCCCCTTCAGGGAGGACCCCCG
CGCACACCAGAACCTCTGGCAAGCCGCCCGACTGCGACTGCTGACCCTGCAGAGCTGGCTGCT
GGACGCACCGTGCTCGCTGCCCGCAGAAGCGGCACTGTGCTGGCGGGCTCCGGGTGGGACCC
CTGCCAGCCACTGGTCCCACCGCTTTCCTGGGAGAACGTCACTGTGGACAAGGTTCTCGAGTT
CCCATTGCTGAAAGGCCACCCTAACCTCTGTGTTCAGGTGAACAGCTCGGAGAAGCTGCAGCT
GCAGGAGTGCTTGTGGGCTGACTCCCTGGGGCCTCTCAAAGACGATGTGCTACTGTTGGAGAC
ACGAGGCCCCCAGGACAACAGATCCCTCTGTGCCTTGGAACCCAGTGGCTGTACTTCACTACC
CAGCAAAGCCTCCACGAGGGCAGCTCGCCTTGGAGAGTACTTACTACAAGACCTGCAGTCAGG
CCAGTGTCTGCAGCTATGGGACGATGACTTGGGAGCGCTATGGGCCTGCCCCATGGACAAATA
CATCCACAAGCGCTGGGCCCTCGTGTGGCTGGCCTGCCTACTCTTTGCCGCTGCGCTTTCCCT
CATCCTCCTTCTCAAAAAGGATCACGCGAAAGGGTGGCTGAGGCTCTTGAAACAGGACGTCCG
CTCGGGGGCGGCCGCCAGGGGCCGCGCGGCTCTGCTCCTCTACTCAGCCGATGACTCGGGTTT
CGAGCGCCTGGTGGGCGCCCTGGCGTCGGCCCTGTGCCAGCTGCCGCTGCGCGTGGCCGTAGA
CCTGTGGAGCCGTCGTGAACTGAGCGCGCAGGGGCCCGTGGCTTGGTTTCACGCGCAGCGGCG
CCAGACCCTGCAGGAGGGCGGCGTGGTGGTCTTGCTCTTCTCTCCCGGTGCGGTGGCGCTGTG
CAGCGAGTGGCTACAGGATGGGGTGTCCGGGCCCGGGGCGCACGGCCCGCACGACGCCTTCCG
CGCCTCGCTCAGCTGCGTGCTGCCCGACTTCTTGCAGGGCCGGGCGCCCGGCAGCTACGTGGG
GGCCTGCTTCGACAGGCTGCTCCACCCGGACGCCGTACCCGCCCTTTTCCGCACCGTGCCCGT
CTTCACACTGCCCTCCCAACTGCCAGACTTCCTGGGGGCCCTGCAGCAGCCTCGCGCCCCGCG
TTCCGGGCGGCTCCAAGAGAGAGCGGAGCAAGTGTCCCGGGCCCTTCAGCCAGCCCTGGATAG
CTACTTCCATCCCCCGGGGACTCCCGCGCCGGGACGCGGGGTGGACCAGGGGCGGGACCTGG
GGCGGGGGACGGGACTTAAATAAAGGCAGACGCTGTTTTCTAAAAAAA

FIGURE 598

```
></usr/seqdb2/sst/DNA/Dnaseqs.full/ss.DNA164625
><subunit 1 of 1, 705 aa, 1 stop
/><MW: 76970, pI: 6.00, NX(S/T): 9
MPVPWFLLSLALGRSPVVLSLERLVGPQDATHCSPGLSCRLWDSDILCLPGDIVPAPGP
VLAPTHLQTELVLRCQKETDCDLCLRVAVHLAVHGHWEEPEDEEKFGGAADSGVEEPRN
ASLQAQVVLSFQAYPTARCVLLEVQVPAALVQFGQSVGSVVYDCFEAALGSEVRIWSYT
QPRYEKELNHTQQLPALPWLNVSADGDNVHLVLNVSEEQHFGLSLYWNQVQGPPKPRWH
KNLTGPQIITLNHTDLVPCLCIQVWPLEPDSVRTNICPFREDPRAHQNLWQAARLRLLT
LQSWLLDAPCSLPAEAALCWRAPGGDPCQPLVPPLSWENVTVDKVLEFPLLKGHPNLCV
QVNSSEKLQLQECLWADSLGPLKDDVLLLETRGPQDNRSLCALEPSGCTSLPSKASTRA
ARLGEYLLQDLQSGQCLQLWDDDLGALWACPMDKYIHKRWALVWLACLLFAAALSLILL
LKKDHAKGWLRLLKQDVRSGAAARGRAALLLYSADDSGFERLVGALASALCQLPLRVAV
DLWSRRELSAQGPVAWFHAQRRQTLQEGGVVVLLFSPGAVALCSEWLQDGVSGPGAHGP
HDAFRASLSCVLPDFLQGRAPGSYVGACFDRLLHPDAVPALFRTVPVFTLPSQLPDFLG
ALQQPRAPRSGRLQERAEQVSRALQPALDSYFHPPGTPAPGRGVGPGAGPGAGDGT
```

Important features of the protein:

Signal peptide:
Amino acids 1-20

Transmembrane domain:
Amino acids 453-473

N-glycosylation sites:
Amino acids 118-122;186-190;198-202;211-215;238-242;
248-252;334-338;357-360;391-395;

Glycosaminoglycan attachment site:
Amino acids 583-587 cAMP- and cGMP-dependent protein kinase phosphorylation site:
Amino acids 552-556

N-myristoylation sites:
Amino acids 107-113;152-158;319-325;438-444;516-522;612-618;
692-698;696-702;700-706

FIGURE 599

GGTCCTTAATGGCAGCAGCCGCCGCTACCAAGATCCTTCTGTGCCTCCCGCTTCTGCTCCTGC
TGTCCGGCTGGTCCCGGGCTGGGCGAGCCGACCCTCACTCTCTTTGCTATGACATCACCGTCA
TCCCTAAGTTCAGACCTGGACCACGGTGGTGTGCGGTTCAAGGCCAGGTGGATGAAAAGACTT
TTCTTCACTATGACTGTGGCAACAAGACAGTCACACCTGTCAGTCCCCTGGGAAGAAACTAA
ATGTCACAACGGCCTGGAAAGCACAGAACCCAGTACTGAGAGAGGTGGTGGACATACTTACAG
AGCAACTGCGTGACATTCAGCTGGAGAATTACACACCCAAGGAACCCCTCACCCTGCAGGCAA
GGATGTCTTGTGAGCAGAAAGCTGAAGGACACAGCAGTGGATCTTGGCAGTTCAGTTTCGATG
GGCAGATCTTCCTCCTCTTTGACTCAGAGAAGAGAATGTGGACAACGGTTCATCCTGGAGCCA
GAAAGATGAAAGAAAAGTGGGAGAATGACAAGGTTGTGGCCATGTCCTTCCATTACTTCTCAA
TGGGAGACTGTATAGGATGGCTTGAGGACTTCTTGATGGGCATGGACAGCACCCTGGAGCCAA
GTGCAGGAGCACCACTCGCCATGTCCTCAGGCACAACCCAACTCAGGGCCACAGCCACCACCC
TCATCCTTTGCTGCCTCCTCATCATCCTCCCCTGCTTCATCCTCCCTGGCATCTGAGGAGAGT
CCTTTAGAGTGACAGGTTAAAGCTGATACCAAAAGGCTCCTGTGAGCACGGTCTTGATCAAAC
TCGCCCTTCTGTCTGGCCAGCTGCCCACGACCTACGGTGTATGTCCAGTGGCCTCCAGCAGAT
CATGATGACATCATGGACCCAATAGCTCATTCACTGCCTTGATTCCTTTTGCCAACAATTTTA
CCAGCAGTTATACCTAACATATTATGCAATTTTCTCTTGGTGCTACCTGATGGAATTCCTGCA
CTTAAAGTTCTGGCTGACTAAACAAGATATATCATTTTCTTTCTTCTCTTTTTGTTTGGAAAA
TCAAGTACTTCTTTGAATGATGATCTCTTTCTTGCAAATGATATTGTCAGTAAAATAATCACG
TTAGACTTCAGACCTCTGGGGATTCTTTCCGTGTCCTGAAAGAGAATTTTTAAATTATTTAAT
AAGAAAAAATTTATATTAATGATTGTTTCCTTTAGTAATTTATTGTTCTGTACTGATATTTAA
ATAAAGAGTTCTATTTCCCAAAAAAAAAAAAAAAAAA

FIGURE 600

MAAAAATKILLCLPLLLLLSGWSRAGRADPHSLCYDITVIPKFRPGPRWCAVQGQVDEKTFLH
YDCGNKTVTPVSPLGKKLNVTTAWKAQNPVLREVVDILTEQLRDIQLENYTPKEPLTLQARMS
CEQKAEGHSSGSWQFSFDGQIFLLFDSEKRMWTTVHPGARKMKEKWENDKVVAMSFHYFSMGD
CIGWLEDFLMGMDSTLEPSAGAPLAMSSGTTQLRATATTLILCCLLIILPCFILPGI

Important features:

Signal peptide:
amino acids 1-25

Transmembrane domain:
amino acids 224-246

N-glycosylation site.
amino acids 68-72, 82-86

N-myristoylation site.
amino acids 200-206, 210-216

Amidation site.
amino acids 77-81

FIGURE 601

GCAGTCAGAGACTTCCCCTGCCCCTCGCTGGGAAAGAACATTAGGAATGCCTTTTAGTGCCTT
GCTTCCTGAACTAGCTCACAGTAGCCCGGCGGCCCAGGGCAATCCGACCACATTTCACTCTCA
CCGCTGTAGGAATCCAGATGCAGGCCAAGTACAGCAGCACGAGGGACATGCTGGATGATGATG
GGGACACCACCATGAGCCTGCATTCTCAAGCCTCTGCCACAACTCGGCATCCAGAGCCCCGGC
GCACAGAGCACAGGGCTCCCTCTTCAACGTGGCGACCAGTGGCCCTGACCCTGCTGACTTTGT
GCTTGGTGCTGCTGATAGGGCTGGCAGCCCTGGGGCTTTTGTTTTTTCAGTACTACCAGCTCT
CCAATACTGGTCAAGACACCATTTCTCAAATGGAAGAAAGATTAGGAAATACGTCCCAAGAGT
TGCAATCTCTTCAAGTCCAGAATATAAAGCTTGCAGGAAGTCTGCAGCATGTGGCTGAAAAAC
TCTGTCGTGAGCTGTATAACAAAGCTGGAGCACACAGGTGCAGCCCTTGTACAGAACAATGGA
AATGGCATGGAGACAATTGCTACCAGTTCTATAAAGACAGCAAAAGTTGGGAGGACTGTAAAT
ATTTCTGCCTTAGTGAAAACTCTACCATGCTGAAGATAAACAAACAAGAAGACCTGGAATTTG
CCGCGTCTCAGAGCTACTCTGAGTTTTTCTACTCTTATTGGACAGGGCTTTTGCGCCCTGACA
GTGGCAAGGCCTGGCTGTGGATGGATGGAACCCCTTTCACTTCTGAACTGTTCCATATTATAA
TAGATGTCACCAGCCCAAGAAGCAGAGACTGTGTGGCCATCCTCAATGGGATGATCTTCTCAA
AGGACTGCAAAGAATTGAAGCGTTGTGTCTGTGAGAGAAGGGCAGGAATGGTGAAGCCAGAGA
GCCTCCATGTCCCCCCTGAAACATTAGGCGAAGGTGACTGATTCGCCCTCTGCAACTACAAAT
AGCAGAGTGAGCCAGGCGGTGCCAAAGCAAGGGCTAGTTGAGACATTGGGAAATGGAACATAA
TCAGGAAAGACTATCTCTCTGACTAGTACAAAATGGGTTCTCGTGTTTCCTGTTCAGGATCAC
CAGCATTTCTGAGCTTGGGTTTATGCACGTATTTAACAGTCACAAGAAGTCTTATTTACATGC
CACCAACCAACCTCAGAAACCCATAATGTCATCTGCCTTCTTGGCTTAGAGATAACTTTTAGC
TCTCTTTCTTCTCAATGTCTAATATCACCTCCCTGTTTTCATGTCTTCCTTACACTTGGTGGA
ATAAGAAACTTTTTGAAGTAGAGGAAATACATTGAGGTAACATCCTTTTCTCTGACAGTCAAG
TAGTCCATCAGAAATTGGCAGTCACTTCCCAGATTGTACCAGCAAATACACAAGGAATTCTTT
TTGTTTGTTTCAGTTCATACTAGTCCCTTCCCAATCCATCAGTAAAGACCCCATCTGCCTTGT
CCATGCCGTTTCCCAACAGGGATGTCACTTGATATGAGAATCTCAAATCTCAATGCCTTATAA
GCATTCCTTCCTGTGTCCATTAAGACTCTGATAATTGTCTCCCCTCCATAGGAATTTCTCCCA
GGAAAGAAATATATCCCCATCTCCGTTTCATATCAGAACTACCGTCCCCGATATTCCCTTCAG
AGAGATTAAAGACCAGAAAAAAGTGAGCCTCTTCATCTGCACCTGTAATAGTTTCAGTTCCTA
TTTTCTTCCATTGACCCATATTTATACCTTTCAGGTACTGAAGATTTAATAATAATAAATGTA
AATACTGTGAAAAA

FIGURE 602

MQAKYSSTRDMLDDDGDTTMSLHSQASATTRHPEPRRTEHRAPSSTWRPVALTLLTLCLVLLI
GLAALGLLFFQYYQLSNTGQDTISQMEERLGNTSQELQSLQVQNIKLAGSLQHVAEKLCRELY
NKAGAHRCSPCTEQWKWHGDNCYQFYKDSKSWEDCKYFCLSENSTMLKINKQEDLEFAASQSY
SEFFYSYWTGLLRPDSGKAWLWMDGTPFTSELFHIIIDVTSPRSRDCVAILNGMIFSKDCKEL
KRCVCERRAGMVKPESLHVPPETLGEGD

FIGURE 603

GGGAGAGAGGATAAATAGCAGCGTGGCTTCCCTGGCTCCTCTCTGCATCCTTCCCGACCTTCC
CAGCAATATGCATCTTGCACGTCTGGTCGGCTCCTGCTCCCTCCTTCTGCTACTGGGGGCCCT
GTCTGGATGGGCGGCCAGCGATGACCCCATTGAGAAGGTCATTGAAGGGATCAACCGAGGGCT
GAGCAATGCAGAGAGAGAGGTGGGCAAGGCCCTGGATGGCATCAACAGTGGAATCACGCATGC
CGGAAGGGAAGTGGAGAAGGTTTTCAACGGACTTAGCAACATGGGGAGCCACACCGGCAAGGA
GTTGGACAAAGGCGTCCAGGGGCTCAACCACGGCATGGACAAGGTTGCCCATGAGATCAACCA
TGGTATTGGACAAGCAGGAAAGGAAGCAGAGAAGCTTGGCCATGGGGTCAACAACGCTGCTGG
ACAGGCCGGGAAGGAAGCAGACAAAGCGGTCCAAGGGTTCCACACTGGGGTCCACCAGGCTGG
GAAGGAAGCAGAGAAACTTGGCCAAGGGGTCAACCATGCTGCTGACCAGGCTGGAAAGGAAGT
GGAGAAGCTTGGCCAAGGTGCCCACCATGCTGCTGGCCAGGCCGGGAAGGAGCTGCAGAATGC
TCATAATGGGGTCAACCAAGCCAGCAAGGAGGCCAACCAGCTGCTGAATGGCAACCATCAAAG
CGGATCTTCCAGCCATCAAGGAGGGGCCACAACCACGCCGTTAGCCTCTGGGGCCTCAGTCAA
CACGCCTTTCATCAACCTTCCCGCCCTGTGGAGGAGCGTCGCCAACATCATGCCCTAAACTGG
CATCCGGCCTTGCTGGGAGAATAATGTCGCCGTTGTCACATCAGCTGACATGACCTGGAGGGG
TTGGGGGTGGGGGACAGGTTTCTGAAATCCCTGAAGGGGGTTGTACTGGGATTTGTGAATAAA
CTTGATACACCA

FIGURE 604

></usr/seqdb2/sst/DNA/Dnaseqs.min/ss.DNA66675
><subunit 1 of 1, 247 aa, 1 stop
><MW: 25335, pI: 7.00, NX(S/T): 0
MHLARLVGSCSLLLLLGALSGWAASDDPIEKVIEGINRGLSNAEREVGKALDGINSGITHAGR
EVEKVFNGLSNMGSHTGKELDKGVQGLNHGMDKVAHEINHGIGQAGKEAEKLGHGVNNAAGQA
GKEADKAVQGFHTGVHQAGKEAEKLGQGVNHAADQAGKEVEKLGQGAHHAAGQAGKELQNAHN
GVNQASKEANQLLNGNHQSGSSSHQGGATTTPLASGASVNTPFINLPALWRSVANIMP

Important features of the protein:
Signal peptide:
amino acids 1-25

Homologous region to circumsporozoite (CS) repeats:
amino acids 35-225

FIGURE 605

GCGACGCGCGGCGGGGCGGCGAGAGGAAACGCGGCGCCGGGCCGGGCCCGGCCCTGGAGATGG
TCCCCGGCGCCGCGGGCTGGTGTTGTCTCGTGCTCTGGCTCCCCGCGTGCGTCGCGGCCCACG
GCTTCCGTATCCATGATTATTTGTACTTTCAAGTGCTGAGTCCTGGGGACATTCGATACATCT
TCACAGCCACACCTGCCAAGGACTTTGGTGGTATCTTTCACACAAGGTATGAGCAGATTCACC
TTGTCCCCGCTGAACCTCCAGAGGCCTGCGGGGAACTCAGCAACGGTTTCTTCATCCAGGACC
AGATTGCTCTGGTGGAGAGGGGGGGCTGCTCCTTCCTCTCCAAGACTCGGGTGGTCCAGGAGC
ACGGCGGGCGGGCGGTGATCATCTCTGACAACGCAGTTGACAATGACAGCTTCTACGTGGAGA
TGATCCAGGACAGTACCCAGCGCACAGCTGACATCCCCGCCCTCTTCCTGCTCGGCCGAGACG
GCTACATGATCCGCCGCTCTCTGGAACAGCATGGGCTGCCATGGGCCATCATTTCCATCCCAG
TCAATGTCACCAGCATCCCCACCTTTGAGCTGCTGCAACCGCCCTGGACCTTCTGGTAGAAGA
GTTTGTCCCACATTCCAGCCATAAGTGACTCTGAGCTGGGAAGGGGAAACCCAGGAATTTTGC
TACTTGGAATTTGGAGATAGCATCTGGGGACAAGTGGAGCCAGGTAGAGGAAAAGGGTTTGGG
CGTTGCTAGGCTGAAAGGGAAGCCACACCACTGGCCTTCCCTTCCCCAGGGCCCCCAAGGGTG
TCTCATGCTACAAGAAGAGGCAAGAGACAGGCCCCAGGGCTTCTGGCTAGAACCCGAAACAAA
AGGAGCTGAAGGCAGGTGGCCTGAGAGCCATCTGTGACCTGTCACACTCACCTGGCTCCAGCC
TCCCCTACCCAGGGTCTCTGCACAGTGACCTTCACAGCAGTTGTTGGAGTGGTTTAAAGAGCT
GGTGTTTGGGGACTCAATAAACCCTCACTGACTTTTTAGCAATAAAGCTTCTCATCAGGGTTG
CAAAAAAAAAAAAAAAAAAAAAAAAAA

FIGURE 606

></usr/seqdb2/sst/DNA/Dnaseqs.min/ss.DNA76532
><subunit 1 of 1, 188 aa, 1 stop
><MW: 21042, pI: 5.36, NX(S/T): 2
MVPGAAGWCCLVLWLPACVAAHGFRIHDYLYFQVLSPGDIRYIFTATPAKDFGGIFHTRYEQI
HLVPAEPPEACGELSNGFFIQDQIALVERGGCSFLSKTRVVQEHGGRAVIISDNAVDNDSFYV
EMIQDSTQRTADIPALFLLGRDGYMIRRSLEQHGLPWAIISIPVNVTSIPTFELLQPPWTFW

Signal peptide:
amino acids 1-20

FIGURE 607

GCATTTGCCACTGGTTGCAGATCAGGCGGACGAGGAGCCGGGAAGGCAGAGCCATGTGGCTGC
CCCCTGCTCTGCTCCTTCTCAGCCTCTCAGGCTGTTTCTCCATCCAAGGCCCAGAGTCTGTGA
GAGCCCCAGAGCAGGGGTCCCTGACGGTTCAATGCCACTATAAGCAAGGATGGGAGACCTACA
TTAAGTGGTGGTGCCGAGGGGTGCGCTGGGATACATGCAAGATCCTCATTGAAACCAGAGGGT
CGGAGCAAGGAGAGAAGAGTGACCGTGTGTCCATCAAGGACAATCAGAAAGACCGCACGTTCA
CTGTGACCATGGAGGGGCTCAGGCGAGATGACGCAGATGTTTACTGGTGTGGGATTGAAAGAA
GAGGACCTGACCTTGGGACTCAAGTGAAAGTGATCGTTGACCCAGAGGGAGCGGCTTCCACAA
CAGCAAGCTCACCTACCAACAGCAATATGGCAGTGTTCATCGGCTCCCACAAGAGGAACCACT
ACATGCTCCTGGTATTTGTGAAGGTGCCCATCTTGCTCATCTTGGTCACTGCCATCCTCTGGT
TGAAGGGGTCTCAGAGGGTCCCTGAGGAGCCAGGGGAACAGCCTATCTACATGAACTTCTCCG
AACCTCTGACTAAAGACATGGCCACTTAGAGAGATGGATCTGCAGAGCCTTCCTGCCCTGGCC
ACGTTTCCAGAAGAGACTCGGGCTGTGGAAGGAACATCTACGAGTCCTCGGGATGCAGTGACT
GAGATAGGGGCCCTGGGCCTCCGCCCTGGCCTTGGAGCTGGTGGGCACCTCCCTGTTCTGCAC
AGCTCAGGGACTTAGCCAGGTCCTCTCCTGAGCCACCATCACCTCCTGGGGTGCCAGCACCTG
TTCTCTTGGTCAGGAGCTGTAGAGATGGAGCTCAAGCACTGGACGACTCTGTCCCCACTGCTG
GAATAACTCGGGCACAGAGCATGGGACCAAAGTACAGAAAGAGGTTGGGGGAGACCCCCCCAG
CCCTAGACTTCCATCATTCCGGAGACCAACTCAACACCGTCTTTGCCTGAGAACCTGATATATCC
GTGTTTTTAAATTTTTTTTTTCTAGCAAAGTTGGGTTTTAATGACTTATGTTCATAGGAAAC
CTCTCTGATCCCACACACAAGGAGGGTGATTCTGGGATGAGTTCCTGGTTCTAGGGCATGAGG
GGCTGGATGGACCCTGTCCCCAGGGAGGACATGGCTCTGAGTCCACAGGGCTGAGGAGGCAAT
GGGAACCTCCCTGGCCCGGCCCGGTGCTTGTCCTCCCCCTCCCACCTCTTCCTCCTCCTAGCT
CCCCAAGCTCCCTGCCTATTCCCCCACCTCCGAGGGGCTGCAGCTTGGGAGCCTCCTCAGCAT
GACAGCTTGGGTCTCCTCCCCAAAAGAGCCTGTCAGGCCTCAAGAACCACCTCCAGGTGGGGA
GGGCAGTAACGAAAACCATCGCAGGAAATGGCACCCTCCCTTTTCGGTGATGTTGAAATCATG
TTACTAATGAAAACTGTCCTAGGGAAGTGGTTCTGTCTCCTCACAGGCTTCACCCACGGCGAT
GAGGCCCTTGAATGTGGTCACTTTGTGCTGTATGGTTGAGGGACCCTCACACCAAAGGGACCT
TCCCATGTGAGATGTGCTCCCGCCCCCACCTGCCCACAAGCAAACACACCACACATGTTCGGC
ATGTTGCCCTTTGAACACCCATGAGGACGCCTCCAACCTGCTCTTGGTTCTAATAGGGAGTAC
TGACTGTCAGCAGTGGATAAAGGAGAGGGGACCCTCTGGTCCCTAGCATGGCACCCAGAGCCT
CCCCTCTTCTTGTCCTTCAGCCAAAGAGAAACTTTCTCTGACTTTGAACTGAATTTAGGTCTC
TGGCCAATGATGGGCCTGAAAATTCCATAATGGCCAGAGAGGAGAGTTCGAGCCCGGCTAAGA
TCCCCTGAGTCATTCTGTGAGGGACCAAGACCCACAGTCCACCAGCCCCAGGGCCCTACCTCC
TGGAATGCTTTCCTGGATCCAGCTTCCCGAAGATCCGACCAGACCCAGGGAGGACGGCACCGC
TCCGCGGGAGGGAAAGCCAAAGCATGGTGCTTCACCAGCTGGACTCAGGGGCGAGGGGACATG
GGCGCTTGTCAACGTGATGTCATTCTTTTCCCACCGTTTCTTCCTGTTGATATTCAATGAATC
CGTCAATCTCTCTGGAAAAAAAAAAAAAAAAAAAAAAAAAAAAAAAAAAAAAAAAAAA

FIGURE 608

></usr/seqdb2/sst/DNA/Dnaseqs.min/ss.DNA105849
><subunit 1 of 1, 201 aa, 1 stop
><MW: 22689, pI: 7.41, NX(S/T): 1
MWLPPALLLLSLSGCFSIQGPESVRAPEQGSLTVQCHYKQGWETYIKWWCRGVRWDTCKI
LIETRGSEQGEKSDRVSIKDNQKDRTFTVTMEGLRRDDADVYWCGIERRGPDLGTQVKVI
VDPEGAASTTASSPTNSNMAVFIGSHKRNHYMLLVFVKVPILLILVTAILWLKGSQRVPE
EPGEQPIYMNFSEPLTKDMAT Important features of the protein:
Signal peptide:
Amino acids     1-17

Transmembrane domain:
Amino acids     151-170

N-glycosylation site:
Amino acids     190-194

Tyrosine kinase phosphorylation site:
Amino acids     95-103

N-myristoylation sites:
Amino acids     66-72;125-131

Prokaryotic membrane lipoprotein lipid attachment site:
Amino acids     5-16

FIGURE 609

GATGGCGCAGCCACAGCTTCTGTGAGATTCGATTTCTCCCCAGTTCCCCTGTGGGTCTGAGGG
GACCAGAAGGGTGAGCTACGTTGGCTTTCTGGAAGGGGAGGCTATATGCGTCAATTCCCCAAA
ACAAGTTTTGACATTTCCCCTGAAATGTCATTCTCTATCTATTCACTGCAAGTGCCTGCTGTT
CCAGGCCTTACCTGCTGGGCACTAACGGCGGAGCCAGGATGGGGACAGAATAAAGGAGCCACG
ACCTGTGCCACCAACTCGCACTCAGACTCTGAACTCAGACCTGAAATCTTCTCTTCACGGGAG
GCTTGGCAGTTTTTCTTACTCCTGTGGTCTCCAGATTTCAGGCCTAAGATGAAAGCCTCTAGT
CTTGCCTTCAGCCTTCTCTCTGCTGCGTTTTATCTCCTATGGACTCCTTCCACTGGACTGAAG
ACACTCAATTTGGGAAGCTGTGTGATCGCCACAAACCTTCAGGAAATACGAAATGGATTTTCT
GAGATACGGGGCAGTGTGCAAGCCAAAGATGGAAACATTGACATCAGAATCTTAAGGAGGACT
GAGTCTTTGCAAGACACAAAGCCTGCGAATCGATGCTGCCTCCTGCGCCATTTGCTAAGACTC
TATCTGGACAGGGTATTTAAAAACTACCAGACCCCTGACCATTATACTCTCCGGAAGATCAGC
AGCCTCGCCAATTCCTTTCTTACCATCAAGAAGGACCTCCGGCTCTCTCATGCCCACATGACA
TGCCATTGTGGGGAGGAAGCAATGAAGAAATACAGCCAGATTCTGAGTCACTTTGAAAAGCTG
GAACCTCAGGCAGCAGTTGTGAAGGCTTTGGGGGAACTAGACATTCTTCTGCAATGGATGGAG
GAGACAGAATAGGAGGAAAGTGATGCTGCTGCTAAGAATATTCGAGGTCAAGAGCTCCAGTCT
TCAATACCTGCAGAGGAGGCATGACCCCAAACCACCATCTCTTTACTGTACTAGTCTTGTGCT
GGTCACAGTGTATCTTATTTATGCATTACTTGCTTCCTTGCATGATTGTCTTTATGCATCCCC
AATCTTAATTGAGACCATACTTGTATAAGATTTTTGTAATATCTTTCTGCTATTGGATATATT
TATTAGTTAATATATTTATTTATTTTTTGCTATTTAATGTATTTATTTTTTTACTTGGACATG
AAACTTTAAAAAAATTCACAGATTATATTTATAACCTGACTAGAGCAGGTGATGTATTTTTAT
ACAGTAAAAAAAAAAAACCTTGTAAATTCTAGAAGAGTGGCTAGGGGGGTTATTCATTTGTAT
TCAACTAAGGACATATTTACTCATGCTGATGCTCTGTGAGATATTTGAAATTGAACCAATGAC
TACTTAGGATGGGTTGTGGAATAAGTTTTGATGTGGAATTGCACATCTACCTTACAATTACTG
ACCATCCCCAGTAGACTCCCCAGTCCCATAATTGTGTATCTTCCAGCCAGGAATCCTACACGG
CCAGCATGTATTTCTACAAATAAAGTTTTCTTTGCATACCAAAAAAAAAAAAAAAAAAA

FIGURE 610

></usr/seqdb2/sst/DNA/Dnaseqs.min/ss.DNA83500
><subunit 1 of 1, 261 aa, 1 stop
><MW: 29667, pI: 8.76, NX(S/T): 0
MRQFPKTSFDISPEMSFSIYSLQVPAVPGLTCWALTAEPGWGQNKGATTCATNSHSDSEL
RPEIFSSREAWQFFLLLWSPDFRPKMKASSLAFSLLSAAFYLLWTPSTGLKTLNLGSCVI
ATNLQEIRNGFSEIRGSVQAKDGNIDIRILRRTESLQDTKPANRCCLLRHLLRLYLDRVF
KNYQTPDHYTLRKISSLANSFLTIKKDLRLSHAHMTCHCGEEAMKKYSQILSHFEKLEPQ
AAVVKALGELDILLQWMEETE

Important features of the protein:
Signal peptide:
Amino acids 1-42 cAMP- and cGMP-dependent protein kinase phosphorylation sites:
Amino acids 192-196;225-229

N-myristoylation sites:
Amino acids 42-48;46-52;136-142

PRO9835 POLYPEPTIDES

RELATED APPLICATIONS

This application is a continuation of, and claims priority under 35 USC §120 to, U.S. application Ser. No. 10/052,586 filed Jan. 15, 2002 now abandoned, which is a continuation of, and claims priority under 35 USC §120 to, PCT Application PCT/US01/06520 filed Feb. 28, 2001, which claims priority under 35 USC § 119 to U.S. provisional application 60/232,887 flIed Sep. 15, 2000.

FIELD OF THE INVENTION

The present invention relates generally to the identification and isolation of novel DNA and to the recombinant production of novel polypeptides.

BACKGROUND OF THE INVENTION

Extracellular proteins play important roles in, among other things, the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including as pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents. Efforts are being undertaken by both industry and academia to identify new, native secreted proteins. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.* 93:7108-7113 (1996); U.S. Pat. No. 5,536,637)].

Membrane-bound proteins and receptors can play important roles in, among other things, the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interactions. The membrane-bound proteins can also be employed for screening of potential peptide or small molecule inhibitors of the relevant receptor/ligand interaction.

Efforts are being undertaken by both industry and academia to identify new, native receptor or membrane-bound proteins. Many efforts are focused on the screening of mammalian recombinant DNA libraries to identify the coding sequences for novel receptor or membrane-bound proteins.

SUMMARY OF THE INVENTION

In one embodiment, the invention provides an isolated nucleic acid molecule comprising a nucleotide sequence that encodes a PRO polypeptide.

In one aspect, the isolated nucleic acid molecule comprises a nucleotide sequence having at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity to (a) a DNA molecule encoding a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein, or (b) the complement of the DNA molecule of (a).

In other aspects, the isolated nucleic acid molecule comprises a nucleotide sequence having at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity to (a) a DNA molecule comprising the coding sequence of a full-length PRO polypeptide cDNA as disclosed herein, the coding sequence of a PRO polypeptide lacking the signal peptide as disclosed herein, the coding sequence of an extracellular domain of a transmembrane PRO polypeptide, with or without the signal peptide, as disclosed herein or the coding sequence of any other specifically defined fragment of the full-length amino acid sequence as disclosed herein, or (b) the complement of the DNA molecule of (a).

In a further aspect, the invention concerns an isolated nucleic acid molecule comprising a nucleotide sequence having at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity to (a) a DNA molecule that encodes the same mature polypeptide encoded by any of the human protein cDNAs deposited with the ATCC as disclosed herein, or (b) the complement of the DNA molecule of (a).

Another aspect the invention provides an isolated nucleic acid molecule comprising a nucleotide sequence encoding a PRO polypeptide which is either transmembrane domain-deleted or transmembrane domain-inactivated, or is complementary to such encoding nucleotide sequence, wherein the transmembrane domain(s) of such polypeptide are disclosed herein. Therefore, soluble extracellular domains of the herein described PRO polypeptides are contemplated.

Another embodiment is directed to fragments of a PRO polypeptide coding sequence, or the complement thereof, that may find use as, for example, hybridization probes, for encoding fragments of a PRO polypeptide that may optionally encode a polypeptide comprising a binding site for an anti-PRO antibody or as antisense oligonucleotide probes. Such nucleic acid fragments are usually at least about 10 nucleotides in length, alternatively at least about 15 nucleotides in length, alternatively at least about 20 nucleotides in length, alternatively at least about 30 nucleotides in length, alternatively at least about 40 nucleotides in length, alternatively at least about 50 nucleotides in length, alternatively at least about 60 nucleotides in length, alternatively at least about 70 nucleotides in length, alternatively at least about 80 nucleotides in length, alternatively at least about 90 nucleotides in length, alternatively at least about 100 nucleotides in length, alternatively at least about 110 nucleotides in length, alternatively at least about 120 nucleotides in length, alternatively at least about 130 nucleotides in length, alternatively at least about 140 nucleotides in length, alternatively at least about 150 nucleotides in length, alternatively at least about 160 nucleotides in length, alternatively at least about 170 nucleotides in length, alternatively at least about 180 nucleotides in length, alternatively at least about 190 nucleotides in length, alternatively at least about 200 nucleotides in length, alternatively at least about 250 nucleotides in length, alternatively at least about 300 nucleotides in length, alternatively at least about 350 nucleotides in length, alternatively at least about 400 nucleotides in length, alternatively at least about 450 nucleotides in length, alternatively at least about 500 nucleotides in length, alternatively at least about 600 nucleotides in length, alternatively at least about 700 nucleotides in length, alternatively at least about 800 nucleotides in length, alternatively at least about 900 nucleotides in length and alternatively at least about 1000 nucleotides in length, wherein in this context the term "about" means the referenced nucleotide sequence length plus or minus 10% of that referenced length. It is noted that novel fragments of a PRO polypeptide-encoding nucleotide sequence may be determined in a routine manner by aligning the PRO polypeptide-encoding nucleotide sequence with other known nucleotide sequences using any of a number of well known sequence alignment programs and determining which PRO polypeptide-encoding nucleotide sequence fragment(s) are novel. All of such PRO polypeptide-encoding nucleotide sequences are contemplated herein. Also contemplated are the PRO polypeptide fragments encoded by these nucleotide molecule fragments, preferably those PRO polypeptide fragments that comprise a binding site for an anti-PRO antibody.

In another embodiment, the invention provides isolated PRO polypeptide encoded by any of the isolated nucleic acid sequences hereinabove identified.

In a certain aspect, the invention concerns an isolated PRO polypeptide, comprising an amino acid sequence having at least about 80% amino acid sequence identity, alternatively at least about 81% amino acid sequence identity, alternatively at least about 82% amino acid sequence identity, alternatively at least about 83% amino acid sequence identity, alternatively at least about 84% amino acid sequence identity, alternatively at least about 85% amino acid sequence identity, alternatively at least about 86% amino acid sequence identity, alternatively at least about 87% amino acid sequence identity, alternatively at least about 88% amino acid sequence identity, alternatively at least about 89% amino acid sequence identity, alternatively at least about 90% amino acid sequence identity, alternatively at least about 91% amino acid sequence identity, alternatively at least about 92% amino acid sequence identity, alternatively at least about 93% amino acid sequence identity, alternatively at least about 94% amino acid sequence identity, alternatively at least about 95% amino acid sequence identity, alternatively at least about 96% amino acid sequence identity, alternatively at least about 97% amino acid sequence identity, alternatively at least about 98% amino acid sequence identity and alternatively at least about 99% amino acid sequence identity to a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein.

In a further aspect, the invention concerns an isolated PRO polypeptide comprising an amino acid sequence having at least about 80% amino acid sequence identity, alternatively at least about 81% amino acid sequence identity, alternatively at least about 82% amino acid sequence identity, alternatively at least about 83% amino acid sequence identity, alternatively at least about 84% amino acid sequence identity, alternatively at least about 85% amino acid sequence identity, alternatively at least about 86% amino acid sequence identity, alternatively at least about 87% amino acid sequence identity, alternatively at least about 88% amino acid sequence identity, alternatively at least about 89% amino acid sequence identity, alternatively at least about 90% amino acid sequence identity, alternatively at least about 91% amino acid sequence identity, alternatively at least about 92% amino acid sequence identity, alternatively at least about 93% amino acid sequence identity, alternatively at least about 94% amino acid sequence identity, alternatively at least about 95% amino acid sequence identity, alternatively at least about 96% amino acid sequence identity, alternatively at least about 97% amino acid sequence identity, alternatively at least about 98% amino acid sequence identity and alternatively at least about 99% amino acid sequence identity to an amino acid sequence encoded by any of the human protein cDNAs deposited with the ATCC as disclosed herein.

In a specific aspect, the invention provides an isolated PRO polypeptide without the N-terminal signal sequence and/or the initiating methionine and is encoded by a nucleotide sequence that encodes such an amino acid sequence as hereinbefore described. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

Another aspect the invention provides an isolated PRO polypeptide which is either transmembrane domain-deleted or transmembrane domain-inactivated. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

In yet another embodiment, the invention concerns agonists and antagonists of a native PRO polypeptide as defined herein. In a particular embodiment, the agonist or antagonist is an anti-PRO antibody or a small molecule.

In a further embodiment, the invention concerns a method of identifying agonists or antagonists to a PRO polypeptide which comprise contacting the PRO polypeptide with a candidate molecule and monitoring a biological activity mediated by said PRO polypeptide. Preferably, the PRO polypeptide is a native PRO polypeptide.

In a still further embodiment, the invention concerns a composition of matter comprising a PRO polypeptide, or an agonist or antagonist of a PRO polypeptide as herein described, or an anti-PRO antibody, in combination with a carrier. Optionally, the carrier is a pharmaceutically acceptable carrier.

Another embodiment of the present invention is directed to the use of a PRO polypeptide, or an agonist or antagonist thereof as hereinbefore described, or an anti-PRO antibody, for the preparation of a medicament useful in the treatment of a condition which is responsive to the PRO polypeptide, an agonist or antagonist thereof or an anti-PRO antibody.

In other embodiments of the present invention, the invention provides vectors comprising DNA encoding any of the herein described polypeptides. Host cell comprising any such vector are also provided. By way of example, the host cells may be CHO cells, *E. coli,* or yeast. A process for producing any of the herein described polypeptides is further provided and comprises culturing host cells under conditions suitable for expression of the desired polypeptide and recovering the desired polypeptide from the cell culture.

In other embodiments, the invention provides chimeric molecules comprising any of the herein described polypeptides fused to a heterologous polypeptide or amino acid sequence. Example of such chimeric molecules comprise any of the herein described polypeptides fused to an epitope tag sequence or a Fc region of an immunoglobulin.

In another embodiment, the invention provides an antibody which binds, preferably specifically, to any of the above or below described polypeptides. Optionally, the antibody is a monoclonal antibody, humanized antibody, antibody fragment or single-chain antibody.

In yet other embodiments, the invention provides oligonucleotide probes which may be useful for isolating genomic and cDNA nucleotide sequences, measuring or detecting expression of an associated gene or as antisense probes, wherein those probes may be derived from any of the above or below described nucleotide sequences. Preferred probe lengths are described above.

In yet other embodiments, the present invention is directed to methods of using the PRO polypeptides of the present invention for a variety of uses based upon the functional biological assay data presented in the Examples below.

BRIEF DESCRIPTION OF THE DRAWINGS

FIG. 1 shows a nucleotide sequence (SEQ ID NO:1) of a native sequence PRO276 cDNA, wherein SEQ ID NO:1 is a clone designated herein as “DNA16435-1208”.

FIG. 2 shows the amino acid sequence (SEQ ID NO:2) derived from the coding sequence of SEQ ID NO:1 shown in FIG. 1.

FIG. 3 shows a nucleotide sequence (SEQ ID NO:3) of a native sequence PRO284 cDNA, wherein SEQ ID NO:3 is a clone designated herein as “DNA23318-1211”.

FIG. 4 shows the amino acid sequence (SEQ ID NO:4) derived from the coding sequence of SEQ ID NO:3 shown in FIG. 3.

FIG. 5 shows a nucleotide sequence (SEQ ID NO:5) of a native sequence PRO193 cDNA, wherein SEQ ID NO:5 is a clone designated herein as “DNA23322-1393”.

FIG. 6 shows the amino acid sequence (SEQ ID NO:6) derived from the coding sequence of SEQ ID NO:5 shown in FIG. 5.

FIG. 7 shows a nucleotide sequence (SEQ ID NO:7) of a native sequence PRO190 cDNA, wherein SEQ ID NO:7 is a clone designated herein as “DNA23334-1392”.

FIG. 8 shows the amino acid sequence (SEQ ID NO:8) derived from the coding sequence of SEQ ID NO:7 shown in FIG. 7.

FIG. 9 shows a nucleotide sequence (SEQ ID NO:9) of a native sequence PRO180 cDNA, wherein SEQ ID NO:9 is a clone designated herein as “DNA26843-1389”.

FIG. 10 shows the amino acid sequence (SEQ ID NO:10) derived from the coding sequence of SEQ ID NO:9 shown in FIG. 9.

FIG. 11 shows a nucleotide sequence (SEQ ID NO:11) of a native sequence PRO194 cDNA, wherein SEQ ID NO:11 is a clone designated herein as “DNA26844-1394”.

FIG. 12 shows the amino acid sequence (SEQ ID NO:12) derived from the coding sequence of SEQ ID NO:11 shown in FIG. 11.

FIG. 13 shows a nucleotide sequence (SEQ ID NO:13) of a native sequence PRO218 cDNA, wherein SEQ ID NO:13 is a clone designated herein as "DNA30867-1335".

FIG. 14 shows the amino acid sequence (SEQ ID NO:14) derived from the coding sequence of SEQ ID NO:13 shown in FIG. 13.

FIG. 15 shows a nucleotide sequence (SEQ ID NO:15) of a native sequence PRO260 cDNA, wherein SEQ ID NO:15 is a clone designated herein as "DNA33470-1175".

FIG. 16 shows the amino acid sequence (SEQ ID NO:16) derived from the coding sequence of SEQ ID NO:15 shown in FIG. 15.

FIG. 17 shows a nucleotide sequence (SEQ ID NO:17) of a native sequence PRO233 cDNA, wherein SEQ ID NO:17 is a clone designated herein as "DNA34436-1238".

FIG. 18 shows the amino acid sequence (SEQ ID NO:18) derived from the coding sequence of SEQ ID NO:17 shown in FIG. 17.

FIG. 19 shows a nucleotide sequence (SEQ ID NO:19) of a native sequence PRO234 cDNA, wherein SEQ ID NO:19 is a clone designated herein as "DNA35557-1137".

FIG. 20 shows the amino acid sequence (SEQ ID NO:20) derived from the coding sequence of SEQ ID NO:19 shown in FIG. 19.

FIG. 21 shows a nucleotide sequence (SEQ ID NO:21) of a native sequence PRO236 cDNA, wherein SEQ ID NO:21 is a clone designated herein as "DNA35599-1168".

FIG. 22 shows the amino acid sequence (SEQ ID NO:22) derived from the coding sequence of SEQ ID NO:21 shown in FIG. 21.

FIG. 23 shows a nucleotide sequence (SEQ ID NO:23) of a native sequence PRO244 cDNA, wherein SEQ ID NO:23 is a clone designated herein as "DNA35668-1171".

FIG. 24 shows the amino acid sequence (SEQ ID NO:24) derived from the coding sequence of SEQ ID NO:23 shown in FIG. 23.

FIG. 25 shows a nucleotide sequence (SEQ ID NO:25) of a native sequence PRO262 cDNA, wherein SEQ ID NO:25 is a clone designated herein as "DNA36992-1168".

FIG. 26 shows the amino acid sequence (SEQ ID NO:26) derived from the coding sequence of SEQ ID NO:25 shown in FIG. 25.

FIG. 27 shows a nucleotide sequence (SEQ ID NO:27) of a native sequence PRO271 cDNA, wherein SEQ ID NO:27 is a clone designated herein as "DNA39423-1182".

FIG. 28 shows the amino acid sequence (SEQ ID NO:28) derived from the coding sequence of SEQ ID NO:27 shown in FIG. 27.

FIG. 29 shows a nucleotide sequence (SEQ ID NO:29) of a native sequence PRO268 cDNA, wherein SEQ ID NO:29 is a clone designated herein as "DNA39427-1179".

FIG. 30 shows the amino acid sequence (SEQ ID NO:30) derived from the coding sequence of SEQ ID NO:29 shown in FIG. 29.

FIG. 31 shows a nucleotide sequence (SEQ ID NO:31) of a native sequence PRO270 cDNA, wherein SEQ ID NO:31 is a clone designated herein as "DNA39510-1181".

FIG. 32 shows the amino acid sequence (SEQ ID NO:32) derived from the coding sequence of SEQ ID NO:31 shown in FIG. 31.

FIG. 33 shows a nucleotide sequence (SEQ ID NO:33) of a native sequence PRO355 cDNA, wherein SEQ ID NO:33 is a clone designated herein as "DNA39518-1247".

FIG. 34 shows the amino acid sequence (SEQ ID NO:34) derived from the coding sequence of SEQ ID NO:33 shown in FIG. 33.

FIG. 35 shows a nucleotide sequence (SEQ ID NO:35) of a native sequence PRO298 cDNA, wherein SEQ ID NO:35 is a clone designated herein as "DNA39975-1210".

FIG. 36 shows the amino acid sequence (SEQ ID NO:36) derived from the coding sequence of SEQ ID NO:35 shown in FIG. 35.

FIG. 37 shows a nucleotide sequence (SEQ ID NO:37) of a native sequence PRO299 cDNA, wherein SEQ ID NO:37 is a clone designated herein as "DNA39976-1215".

FIG. 38 shows the amino acid sequence (SEQ ID NO:38) derived from the coding sequence of SEQ ID NO:37 shown in FIG. 37.

FIG. 39 shows a nucleotide sequence (SEQ ID NO:39) of a native sequence PRO296 cDNA, wherein SEQ ID NO:39 is a clone designated herein as "DNA39979-1213".

FIG. 40 shows the amino acid sequence (SEQ ID NO:40) derived from the coding sequence of SEQ ID NO:39 shown in FIG. 39.

FIG. 41 shows a nucleotide sequence (SEQ ID NO:41) of a native sequence PRO329 cDNA, wherein SEQ ID NO:41 is a clone designated herein as "DNA40594-1233".

FIG. 42 shows the amino acid sequence (SEQ ID NO:42) derived from the coding sequence of SEQ ID NO:41 shown in FIG. 41.

FIG. 43 shows a nucleotide sequence (SEQ ID NO:43) of a native sequence PRO330 cDNA, wherein SEQ ID NO:43 is a clone designated herein as "DNA40603-1232".

FIG. 44 shows the amino acid sequence (SEQ ID NO:44) derived from the coding sequence of SEQ ID NO:43 shown in FIG. 43.

FIG. 45 shows a nucleotide sequence (SEQ ID NO:45) of a native sequence PRO294 cDNA, wherein SEQ ID NO:45 is a clone designated herein as "DNA40604-1187".

FIG. 46 shows the amino acid sequence (SEQ ID NO:46) derived from the coding sequence of SEQ ID NO:45 shown in FIG. 45.

FIG. 47 shows a nucleotide sequence (SEQ ID NO:47) of a native sequence PRO300 cDNA, wherein SEQ ID NO:47 is a clone designated herein as "DNA40625-1189".

FIG. 48 shows the amino acid sequence (SEQ ID NO:48) derived from the coding sequence of SEQ ID NO:47 shown in FIG. 47.

FIG. 49 shows a nucleotide sequence (SEQ ID NO:49) of a native sequence PRO307 cDNA, wherein SEQ ID NO:49 is a clone designated herein as "DNA41225-1217".

FIG. 50 shows the amino acid sequence (SEQ ID NO:50) derived from the coding sequence of SEQ ID NO:49 shown in FIG. 49.

FIG. 51 shows a nucleotide sequence (SEQ ID NO:51) of a native sequence PRO334 cDNA, wherein SEQ ID NO:51 is a clone designated herein as "DNA41379-1236".

FIG. 52 shows the amino acid sequence (SEQ ID NO:52) derived from the coding sequence of SEQ ID NO:51 shown in FIG. 51.

FIG. 53 shows a nucleotide sequence (SEQ ID NO:53) of a native sequence PRO352 cDNA, wherein SEQ ID NO:53 is a clone designated herein as "DNA41386-1316".

FIG. 54 shows the amino acid sequence (SEQ ID NO:54) derived from the coding sequence of SEQ ID NO:53 shown in FIG. 53.

FIG. 55 shows a nucleotide sequence (SEQ ID NO:55) of a native sequence PRO710 cDNA, wherein SEQ ID NO:55 is a clone designated herein as "DNA44161-1434".

FIG. 56 shows the amino acid sequence (SEQ ID NO:56) derived from the coding sequence of SEQ ID NO:55 shown in FIG. 55.

FIG. 57 shows a nucleotide sequence (SEQ ID NO:57) of a native sequence PRO873 cDNA, wherein SEQ ID NO:57 is a clone designated herein as "DNA44179-1362".

FIG. 58 shows the amino acid sequence (SEQ ID NO:58) derived from the coding sequence of SEQ ID NO:57 shown in FIG. 57.

FIG. 59 shows a nucleotide sequence (SEQ ID NO:59) of a native sequence PRO354 cDNA, wherein SEQ ID NO:59 is a clone designated herein as "DNA44192-1246".

FIG. 60 shows the amino acid sequence (SEQ ID NO:60) derived from the coding sequence of SEQ ID NO:59 shown in FIG. 59.

FIG. 61 shows a nucleotide sequence (SEQ ID NO:61) of a native sequence PRO1151 cDNA, wherein SEQ ID NO:61 is a clone designated herein as "DNA44694-1500".

FIG. 62 shows the amino acid sequence (SEQ ID NO:62) derived from the coding sequence of SEQ ID NO:61 shown in FIG. 61.

FIG. 63 shows a nucleotide sequence (SEQ ID NO:63) of a native sequence PRO382 cDNA, wherein SEQ ID NO:63 is a clone designated herein as "DNA45234-1277".

FIG. 64 shows the amino acid sequence (SEQ ID NO:64) derived from the coding sequence of SEQ ID NO:63 shown in FIG. 63.

FIG. 65 shows a nucleotide sequence (SEQ ID NO:65) of a native sequence PRO1864 cDNA, wherein SEQ ID NO:65 is a clone designated herein as "DNA45409-2511".

FIG. 66 shows the amino acid sequence (SEQ ID NO:66) derived from the coding sequence of SEQ ID NO:65 shown in FIG. 65.

FIG. 67 shows a nucleotide sequence (SEQ ID NO:67) of a native sequence PRO386 cDNA, wherein SEQ ID NO:67 is a clone designated herein as "DNA45415-1318".

FIG. 68 shows the amino acid sequence (SEQ ID NO:68) derived from the coding sequence of SEQ ID NO:67 shown in FIG. 67.

FIG. 69 shows a nucleotide sequence (SEQ ID NO:69) of a native sequence PRO541 cDNA, wherein SEQ ID NO:69 is a clone designated herein as "DNA45417-1432".

FIG. 70 shows the amino acid sequence (SEQ ID NO:70) derived from the coding sequence of SEQ ID NO:69 shown in FIG. 69.

FIG. 71 shows a nucleotide sequence (SEQ ID NO:71) of a native sequence PRO852 cDNA, wherein SEQ ID NO:71 is a clone designated herein as "DNA45493-1349".

FIG. 72 shows the amino acid sequence (SEQ ID NO:72) derived from the coding sequence of SEQ ID NO:71 shown in FIG. 71.

FIG. 73 shows a nucleotide sequence (SEQ ID NO:73) of a native sequence PRO700 cDNA, wherein SEQ ID NO:73 is a clone designated herein as "DNA46776-1284".

FIG. 74 shows the amino acid sequence (SEQ ID NO:74) derived from the coding sequence of SEQ ID NO:73 shown in FIG. 73.

FIGS. 75A-75B show a nucleotide sequence (SEQ ID NO:75) of a native sequence PRO708 cDNA, wherein SEQ ID NO:75 is a clone designated herein as "DNA48296-1292".

FIG. 76 shows the amino acid sequence (SEQ ID NO:76) derived from the coding sequence of SEQ ID NO:75 shown in FIGS. 75A-75B.

FIG. 77 shows a nucleotide sequence (SEQ ID NO:77) of a native sequence PRO707 cDNA, wherein SEQ ID NO:77 is a clone designated herein as "DNA48306-1291".

FIG. 78 shows the amino acid sequence (SEQ ID NO:78) derived from the coding sequence of SEQ ID NO:77 shown in FIG. 77.

FIG. 79 shows a nucleotide sequence (SEQ ID NO:79) of a native sequence PRO864 cDNA, wherein SEQ ID NO:79 is a clone designated herein as "DNA48328-1355".

FIG. 80 shows the amino acid sequence (SEQ ID NO:80) derived from the coding sequence of SEQ ID NO:79 shown in FIG. 79.

FIG. 81 shows a nucleotide sequence (SEQ ID NO:81) of a native sequence PRO706 cDNA, wherein SEQ ID NO:81 is a clone designated herein as "DNA48329-1290".

FIG. 82 shows the amino acid sequence (SEQ ID NO:82) derived from the coding sequence of SEQ ID NO:81 shown in FIG. 81.

FIG. 83 shows a nucleotide sequence (SEQ ID NO:83) of a native sequence PRO732 cDNA, wherein SEQ ID NO:83 is a clone designated herein as "DNA48334-1435".

FIG. 84 shows the amino acid sequence (SEQ ID NO:84) derived from the coding sequence of SEQ ID NO:83 shown in FIG. 83.

FIG. 85 shows a nucleotide sequence (SEQ ID NO:85) of a native sequence PRO537 cDNA, wherein SEQ ID NO:85 is a clone designated herein as "DNA49141-1431".

FIG. 86 shows the amino acid sequence (SEQ ID NO:86) derived from the coding sequence of SEQ ID NO:85 shown in FIG. 85.

FIG. 87 shows a nucleotide sequence (SEQ ID NO:87) of a native sequence PRO545 cDNA, wherein SEQ ID NO:87 is a clone designated herein as "DNA49624-1279".

FIG. 88 shows the amino acid sequence (SEQ ID NO:88) derived from the coding sequence of SEQ ID NO:87 shown in FIG. 87.

FIG. 89 shows a nucleotide sequence (SEQ ID NO:89) of a native sequence PRO718 cDNA, wherein SEQ ID NO:89 is a clone designated herein as "DNA49647-1398".

FIG. 90 shows the amino acid sequence (SEQ ID NO:90) derived from the coding sequence of SEQ ID NO:89 shown in FIG. 89.

FIG. 91 shows a nucleotide sequence (SEQ ID NO:91) of a native sequence PRO872 cDNA, wherein SEQ ID NO:91 is a clone designated herein as "DNA49819-1439".

FIG. 92 shows the amino acid sequence (SEQ ID NO:92) derived from the coding sequence of SEQ ID NO:91 shown in FIG. 91.

FIG. 93 shows a nucleotide sequence (SEQ ID NO:93) of a native sequence PRO704 cDNA, wherein SEQ ID NO:93 is a clone designated herein as "DNA50911-1288".

FIG. 94 shows the amino acid sequence (SEQ ID NO:94) derived from the coding sequence of SEQ ID NO:93 shown in FIG. 93.

FIG. 95 shows a nucleotide sequence (SEQ ID NO:95) of a native sequence PRO705 cDNA, wherein SEQ ID NO:95 is a clone designated herein as "DNA50914-1289".

FIG. 96 shows the amino acid sequence (SEQ ID NO:96) derived from the coding sequence of SEQ ID NO:95 shown in FIG. 95.

FIG. 97 shows a nucleotide sequence (SEQ ID NO:97) of a native sequence PRO871 cDNA, wherein SEQ ID NO:97 is a clone designated herein as "DNA50919-1361".

FIG. 98 shows the amino acid sequence (SEQ ID NO:98) derived from the coding sequence of SEQ ID NO:97 shown in FIG. 97.

FIG. 99 shows a nucleotide sequence (SEQ ID NO:99) of a native sequence PRO702 cDNA, wherein SEQ ID NO:99 is a clone designated herein as "DNA50980-1286".

FIG. 100 shows the amino acid sequence (SEQ ID NO:100) derived from the coding sequence of SEQ ID NO:99 shown in FIG. 99.

FIG. 101 shows a nucleotide sequence (SEQ ID NO:101) of a native sequence PRO944 cDNA, wherein SEQ ID NO:101 is a clone designated herein as "DNA52185-1370".

FIG. 102 shows the amino acid sequence (SEQ ID NO:102) derived from the coding sequence of SEQ ID NO:101 shown in FIG. 101.

FIG. 103 shows a nucleotide sequence (SEQ ID NO:103) of a native sequence PRO739 cDNA, wherein SEQ ID NO:103 is a clone designated herein as "DNA52756".

FIG. 104 shows the amino acid sequence (SEQ ID NO:104) derived from the coding sequence of SEQ ID NO:103 shown in FIG. 103.

FIG. 105 shows a nucleotide sequence (SEQ ID NO:105) of a native sequence PRO941 cDNA, wherein SEQ ID NO:105 is a clone designated herein as "DNA53906-1368".

FIG. 106 shows the amino acid sequence (SEQ ID NO:106) derived from the coding sequence of SEQ ID NO:105 shown in FIG. 105.

FIG. 107 shows a nucleotide sequence (SEQ ID NO:107) of a native sequence PRO1082 cDNA, wherein SEQ ID NO:107 is a clone designated herein as "DNA53912-1457".

FIG. 108 shows the amino acid sequence (SEQ ID NO:108) derived from the coding sequence of SEQ ID NO:107 shown in FIG. 107.

FIG. 109 shows a nucleotide sequence (SEQ ID NO:109) of a native sequence PRO1133 cDNA, wherein SEQ ID NO:109 is a clone designated herein as "DNA53913-1490".

FIG. 110 shows the amino acid sequence (SEQ ID NO:110) derived from the coding sequence of SEQ ID NO:109 shown in FIG. 109.

FIG. 111 shows a nucleotide sequence (SEQ ID NO:111) of a native sequence PRO983 cDNA, wherein SEQ ID NO:111 is a clone designated herein as "DNA53977-1371".

FIG. 112 shows the amino acid sequence (SEQ ID NO:112) derived from the coding sequence of SEQ ID NO:111 shown in FIG. 111.

FIG. 113 shows a nucleotide sequence (SEQ ID NO:113) of a native sequence PRO784 cDNA, wherein SEQ ID NO:113 is a clone designated herein as "DNA53978-1443".

FIG. 114 shows the amino acid sequence (SEQ ID NO:114) derived from the coding sequence of SEQ ID NO:113 shown in FIG. 113.

FIG. 115 shows a nucleotide sequence (SEQ ID NO:115) of a native sequence PRO783 cDNA, wherein SEQ ID NO:115 is a clone designated herein as "DNA53996-1442".

FIG. 116 shows the amino acid sequence (SEQ ID NO:116) derived from the coding sequence of SEQ ID NO:115 shown in FIG. 115.

FIG. 117 shows a nucleotide sequence (SEQ ID NO:117) of a native sequence PRO940 cDNA, wherein SEQ ID NO:117 is a clone designated herein as "DNA54002-1367".

FIG. 118 shows the amino acid sequence (SEQ ID NO:118) derived from the coding sequence of SEQ ID NO:117 shown in FIG. 117.

FIG. 119 shows a nucleotide sequence (SEQ ID NO:119) of a native sequence PRO768 cDNA, wherein SEQ ID NO:119 is a clone designated herein as "DNA55737-1345".

FIG. 120 shows the amino acid sequence (SEQ ID NO:120) derived from the coding sequence of SEQ ID NO:119 shown in FIG. 119.

FIG. 121 shows a nucleotide sequence (SEQ ID NO:121) of a native sequence PRO1079 cDNA, wherein SEQ ID NO:121 is a clone designated herein as "DNA56050-1455".

FIG. 122 shows the amino acid sequence (SEQ ID NO:122) derived from the coding sequence of SEQ ID NO:121 shown in FIG. 121.

FIG. 123 shows a nucleotide sequence (SEQ ID NO:123) of a native sequence PRO1078 cDNA, wherein SEQ ID NO:123 is a clone designated herein as "DNA56052-1454".

FIG. 124 shows the amino acid sequence (SEQ ID NO:124) derived from the coding sequence of SEQ ID NO:123 shown in FIG. 123.

FIG. 125 shows a nucleotide sequence (SEQ ID NO:125) of a native sequence PRO1018 cDNA, wherein SEQ ID NO:125 is a clone designated herein as "DNA56107-1415".

FIG. 126 shows the amino acid sequence (SEQ ID NO:126) derived from the coding sequence of SEQ ID NO:125 shown in FIG. 125.

FIG. 127 shows a nucleotide sequence (SEQ ID NO:127) of a native sequence PRO793 cDNA, wherein SEQ ID NO:127 is a clone designated herein as "DNA56110-1437".

FIG. 128 shows the amino acid sequence (SEQ ID NO:128) derived from the coding sequence of SEQ ID NO:127 shown in FIG. 127.

FIG. 129 shows a nucleotide sequence (SEQ ID NO:129) of a native sequence PRO1773 cDNA, wherein SEQ ID NO:129 is a clone designated herein as "DNA56406-1704".

FIG. 130 shows the amino acid sequence (SEQ ID NO:130) derived from the coding sequence of SEQ ID NO:129 shown in FIG. 129.

FIG. 131 shows a nucleotide sequence (SEQ ID NO:131) of a native sequence PRO1014 cDNA, wherein SEQ ID NO:131 is a clone designated herein as "DNA56409-1377".

FIG. 132 shows the amino acid sequence (SEQ ID NO:132) derived from the coding sequence of SEQ ID NO:131 shown in FIG. 131.

FIG. 133 shows a nucleotide sequence (SEQ ID NO:133) of a native sequence PRO1013 cDNA, wherein SEQ ID NO:133 is a clone designated herein as "DNA56410-1414".

FIG. 134 shows the amino acid sequence (SEQ ID NO:134) derived from the coding sequence of SEQ ID NO:133 shown in FIG. 133.

FIG. 135 shows a nucleotide sequence (SEQ ID NO:135) of a native sequence PRO937 cDNA, wherein SEQ ID NO:135 is a clone designated herein as "DNA56436-1448".

FIG. 136 shows the amino acid sequence (SEQ ID NO:136) derived from the coding sequence of SEQ ID NO:135 shown in FIG. 135.

FIG. 137 shows a nucleotide sequence (SEQ ID NO:137) of a native sequence PRO1477 cDNA, wherein SEQ ID NO:137 is a clone designated herein as "DNA56529-1647".

FIG. 138 shows the amino acid sequence (SEQ ID NO:138) derived from the coding sequence of SEQ ID NO:137 shown in FIG. 137.

FIG. 139 shows a nucleotide sequence (SEQ ID NO:139) of a native sequence PRO842 cDNA, wherein SEQ ID NO:139 is a clone designated herein as "DNA56855-1447".

FIG. 140 shows the amino acid sequence (SEQ ID NO:140) derived from the coding sequence of SEQ ID NO:139 shown in FIG. 139.

FIG. 141 shows a nucleotide sequence (SEQ ID NO:141) of a native sequence PRO839 cDNA, wherein SEQ ID NO:141 is a clone designated herein as "DNA56859-1445".

FIG. 142 shows the amino acid sequence (SEQ ID NO:142) derived from the coding sequence of SEQ ID NO:141 shown in FIG. 141.

FIG. 143 shows a nucleotide sequence (SEQ ID NO:143) of a native sequence PRO1180 cDNA, wherein SEQ ID NO:143 is a clone designated herein as "DNA56860-1510".

FIG. 144 shows the amino acid sequence (SEQ ID NO:144) derived from the coding sequence of SEQ ID NO:143 shown in FIG. 143.

FIG. 145 shows a nucleotide sequence (SEQ ID NO:145) of a native sequence PRO1134 cDNA, wherein SEQ ID NO:145 is a clone designated herein as "DNA56865-1491".

FIG. 146 shows the amino acid sequence (SEQ ID NO:146) derived from the coding sequence of SEQ ID NO:145 shown in FIG. 145.

FIG. 147 shows a nucleotide sequence (SEQ ID NO:147) of a native sequence PRO1115 cDNA, wherein SEQ ID NO:147 is a clone designated herein as "DNA56868-1478".

FIG. 148 shows the amino acid sequence (SEQ ID NO:148) derived from the coding sequence of SEQ ID NO:147 shown in FIG. 147.

FIG. 149 shows a nucleotide sequence (SEQ ID NO:149) of a native sequence PRO1277 cDNA, wherein SEQ ID NO:149 is a clone designated herein as "DNA56869-1545".

FIG. 150 shows the amino acid sequence (SEQ ID NO:150) derived from the coding sequence of SEQ ID NO:149 shown in FIG. 149.

FIG. 151 shows a nucleotide sequence (SEQ ID NO:151) of a native sequence PRO1135 cDNA, wherein SEQ ID NO:151 is a clone designated herein as "DNA56870-1492".

FIG. 152 shows the amino acid sequence (SEQ ID NO:152) derived from the coding sequence of SEQ ID NO:151 shown in FIG. 151.

FIG. 153 shows a nucleotide sequence (SEQ ID NO:153) of a native sequence PRO827 cDNA, wherein SEQ ID NO:153 is a clone designated herein as "DNA57039-1402".

FIG. 154 shows the amino acid sequence (SEQ ID NO:154) derived from the coding sequence of SEQ ID NO:153 shown in FIG. 153.

FIG. 155 shows a nucleotide sequence (SEQ ID NO:155) of a native sequence PRO1057 cDNA, wherein SEQ ID NO:155 is a clone designated herein as "DNA57253-1382".

FIG. 156 shows the amino acid sequence (SEQ ID NO:156) derived from the coding sequence of SEQ ID NO:155 shown in FIG. 155.

FIG. 157 shows a nucleotide sequence (SEQ ID NO:157) of a native sequence PRO1113 cDNA, wherein SEQ ID NO:157 is a clone designated herein as "DNA57254-1477".

FIG. 158 shows the amino acid sequence (SEQ ID NO:158) derived from the coding sequence of SEQ ID NO:157 shown in FIG. 157.

FIG. 159 shows a nucleotide sequence (SEQ ID NO:159) of a native sequence PRO1006 cDNA, wherein SEQ ID NO:159 is a clone designated herein as "DNA57699-1412".

FIG. 160 shows the amino acid sequence (SEQ ID NO:160) derived from the coding sequence of SEQ ID NO:159 shown in FIG. 159.

FIG. 161 shows a nucleotide sequence (SEQ ID NO:161) of a native sequence PRO1074 cDNA, wherein SEQ ID NO:161 is a clone designated herein as "DNA57704-1452".

FIG. 162 shows the amino acid sequence (SEQ ID NO:162) derived from the coding sequence of SEQ ID NO:161 shown in FIG. 161.

FIG. 163 shows a nucleotide sequence (SEQ ID NO:163) of a native sequence PRO1073 cDNA, wherein SEQ ID NO:163 is a clone designated herein as "DNA57710-1451".

FIG. 164 shows the amino acid sequence (SEQ ID NO:164) derived from the coding sequence of SEQ ID NO:163 shown in FIG. 163.

FIG. 165 shows a nucleotide sequence (SEQ ID NO:165) of a native sequence PRO1136 cDNA, wherein SEQ ID NO:165 is a clone designated herein as "DNA57827-1493".

FIG. 166 shows the amino acid sequence (SEQ ID NO:166) derived from the coding sequence of SEQ ID NO:165 shown in FIG. 165.

FIG. 167 shows a nucleotide sequence (SEQ ID NO:167) of a native sequence PRO1004 cDNA, wherein SEQ ID NO:167 is a clone designated herein as "DNA57844-1410".

FIG. 168 shows the amino acid sequence (SEQ ID NO:168) derived from the coding sequence of SEQ ID NO:167 shown in FIG. 167.

FIG. 169 shows a nucleotide sequence (SEQ ID NO:169) of a native sequence PRO1344 cDNA, wherein SEQ ID NO:169 is a clone designated herein as "DNA58723-1588".

FIG. 170 shows the amino acid sequence (SEQ ID NO:170) derived from the coding sequence of SEQ ID NO:169 shown in FIG. 169.

FIG. 171 shows a nucleotide sequence (SEQ ID NO:171) of a native sequence PRO1110 cDNA, wherein SEQ ID NO:171 is a clone designated herein as "DNA58727-1474".

FIG. 172 shows the amino acid sequence (SEQ ID NO:172) derived from the coding sequence of SEQ ID NO:171 shown in FIG. 171.

FIG. 173 shows a nucleotide sequence (SEQ ID NO:173) of a native sequence PRO1378 cDNA, wherein SEQ ID NO:173 is a clone designated herein as "DNA58730-1607".

FIG. 174 shows the amino acid sequence (SEQ ID NO:174) derived from the coding sequence of SEQ ID NO:173 shown in FIG. 173.

FIG. 175 shows a nucleotide sequence (SEQ ID NO:175) of a native sequence PRO1481 cDNA, wherein SEQ ID NO:175 is a clone designated herein as "DNA58732-1650".

FIG. 176 shows the amino acid sequence (SEQ ID NO:176) derived from the coding sequence of SEQ ID NO:175 shown in FIG. 175.

FIG. 177 shows a nucleotide sequence (SEQ ID NO:177) of a native sequence PRO1109 cDNA, wherein SEQ ID NO:177 is a clone designated herein as "DNA58737-1473".

FIG. 178 shows the amino acid sequence (SEQ ID NO:178) derived from the coding sequence of SEQ ID NO:177 shown in FIG. 177.

FIG. 179 shows a nucleotide sequence (SEQ ID NO:179) of a native sequence PRO1383 cDNA, wherein SEQ ID NO:179 is a clone designated herein as "DNA58743-1609".

FIG. 180 shows the amino acid sequence (SEQ ID NO:180) derived from the coding sequence of SEQ ID NO:179 shown in FIG. 179.

FIG. 181 shows a nucleotide sequence (SEQ ID NO:181) of a native sequence PRO1072 cDNA, wherein SEQ ID NO:181 is a clone designated herein as "DNA58747-1384".

FIG. 182 shows the amino acid sequence (SEQ ID NO:182) derived from the coding sequence of SEQ ID NO:181 shown in FIG. 181.

FIG. 183 shows a nucleotide sequence (SEQ ID NO:183) of a native sequence PRO1189 cDNA, wherein SEQ ID NO:183 is a clone designated herein as "DNA58828-1519".

FIG. 184 shows the amino acid sequence (SEQ ID NO:184) derived from the coding sequence of SEQ ID NO:183 shown in FIG. 183.

FIG. 185 shows a nucleotide sequence (SEQ ID NO:185) of a native sequence PRO1003 cDNA, wherein SEQ ID NO:185 is a clone designated herein as "DNA58846-1409".

FIG. 186 shows the amino acid sequence (SEQ ID NO:186) derived from the coding sequence of SEQ ID NO:185 shown in FIG. 185.

FIG. 187 shows a nucleotide sequence (SEQ ID NO:187) of a native sequence PRO1108 cDNA, wherein SEQ ID NO:187 is a clone designated herein as "DNA58848-1472".

FIG. 188 shows the amino acid sequence (SEQ ID NO:188) derived from the coding sequence of SEQ ID NO:187 shown in FIG. 187.

FIG. 189 shows a nucleotide sequence (SEQ ID NO:189) of a native sequence PRO1137 cDNA, wherein SEQ ID NO:189 is a clone designated herein as "DNA58849-1494".

FIG. 190 shows the amino acid sequence (SEQ ID NO:190) derived from the coding sequence of SEQ ID NO:189 shown in FIG. 189.

FIG. 191 shows a nucleotide sequence (SEQ ID NO:191) of a native sequence PRO1138 cDNA, wherein SEQ ID NO:191 is a clone designated herein as "DNA58850-1495".

FIG. 192 shows the amino acid sequence (SEQ ID NO:192) derived from the coding sequence of SEQ ID NO:191 shown in FIG. 191.

FIG. 193 shows a nucleotide sequence (SEQ ID NO:193) of a native sequence PRO1415 cDNA, wherein SEQ ID NO:193 is a clone designated herein as "DNA58852-1637".

FIG. 194 shows the amino acid sequence (SEQ ID NO:194) derived from the coding sequence of SEQ ID NO:193 shown in FIG. 193.

FIG. 195 shows a nucleotide sequence (SEQ ID NO:195) of a native sequence PRO1054 cDNA, wherein SEQ ID NO:195 is a clone designated herein as "DNA58853-1423".

FIG. 196 shows the amino acid sequence (SEQ ID NO:196) derived from the coding sequence of SEQ ID NO:195 shown in FIG. 195.

FIG. 197 shows a nucleotide sequence (SEQ ID NO:197) of a native sequence PRO994 cDNA, wherein SEQ ID NO:197 is a clone designated herein as "DNA58855-1422".

FIG. 198 shows the amino acid sequence (SEQ ID NO:198) derived from the coding sequence of SEQ ID NO:197 shown in FIG. 197.

FIG. 199 shows a nucleotide sequence (SEQ ID NO:199) of a native sequence PRO1069 cDNA, wherein SEQ ID NO:199 is a clone designated herein as "DNA59211-1450".

FIG. 200 shows the amino acid sequence (SEQ ID NO:200) derived from the coding sequence of SEQ ID NO:199 shown in FIG. 199.

FIG. 201 shows a nucleotide sequence (SEQ ID NO:201) of a native sequence PRO1411 cDNA, wherein SEQ ID NO:201 is a clone designated herein as "DNA59212-1627".

FIG. 202 shows the amino acid sequence (SEQ ID NO:202) derived from the coding sequence of SEQ ID NO:201 shown in FIG. 201.

FIG. 203 shows a nucleotide sequence (SEQ ID NO:203) of a native sequence PRO1129 cDNA, wherein SEQ ID NO:203 is a clone designated herein as "DNA59213-1487".

FIG. 204 shows the amino acid sequence (SEQ ID NO:204) derived from the coding sequence of SEQ ID NO:203 shown in FIG. 203.

FIG. 205 shows a nucleotide sequence (SEQ ID NO:205) of a native sequence PRO1359 cDNA, wherein SEQ ID NO:205 is a clone designated herein as "DNA59219-1613".

FIG. 206 shows the amino acid sequence (SEQ ID NO:206) derived from the coding sequence of SEQ ID NO:205 shown in FIG. 205.

FIG. 207 shows a nucleotide sequence (SEQ ID NO:207) of a native sequence PRO1139 cDNA, wherein SEQ ID NO:207 is a clone designated herein as "DNA59497-1496".

FIG. 208 shows the amino acid sequence (SEQ ID NO:208) derived from the coding sequence of SEQ ID NO:207 shown in FIG. 207.

FIG. 209 shows a nucleotide sequence (SEQ ID NO:209) of a native sequence PRO1065 cDNA, wherein SEQ ID NO:209 is a clone designated herein as "DNA59602-1436".

FIG. 210 shows the amino acid sequence (SEQ ID NO:210) derived from the coding sequence of SEQ ID NO:209 shown in FIG. 209.

FIG. 211 shows a nucleotide sequence (SEQ ID NO:211) of a native sequence PRO1028 cDNA, wherein SEQ ID NO:211 is a clone designated herein as "DNA59603-1419".

FIG. 212 shows the amino acid sequence (SEQ ID NO:212) derived from the coding sequence of SEQ ID NO:211 shown in FIG. 211.

FIG. 213 shows a nucleotide sequence (SEQ ID NO:213) of a native sequence PRO1027 cDNA, wherein SEQ ID NO:213 is a clone designated herein as "DNA59605-1418".

FIG. 214 shows the amino acid sequence (SEQ ID NO:214) derived from the coding sequence of SEQ ID NO:213 shown in FIG. 213.

FIG. 215 shows a nucleotide sequence (SEQ ID NO:215) of a native sequence PRO1140 cDNA, wherein SEQ ID NO:215 is a clone designated herein as "DNA59607-1497".

FIG. 216 shows the amino acid sequence (SEQ ID NO:216) derived from the coding sequence of SEQ ID NO:215 shown in FIG. 215.

FIG. 217 shows a nucleotide sequence (SEQ ID NO:217) of a native sequence PRO1291 cDNA, wherein SEQ ID NO:217 is a clone designated herein as "DNA59610-1556".

FIG. 218 shows the amino acid sequence (SEQ ID NO:218) derived from the coding sequence of SEQ ID NO:217 shown in FIG. 217.

FIG. 219 shows a nucleotide sequence (SEQ ID NO:219) of a native sequence PRO1105 cDNA, wherein SEQ ID NO:219 is a clone designated herein as "DNA59612-1466".

FIG. 220 shows the amino acid sequence (SEQ ID NO:220) derived from the coding sequence of SEQ ID NO:219 shown in FIG. 219.

FIG. 221 shows a nucleotide sequence (SEQ ID NO:221) of a native sequence PRO1026 cDNA, wherein SEQ ID NO:221 is a clone designated herein as "DNA59613-1417".

FIG. 222 shows the amino acid sequence (SEQ ID NO:222) derived from the coding sequence of SEQ ID NO:221 shown in FIG. 221.

FIG. 223 shows a nucleotide sequence (SEQ ID NO:223) of a native sequence PRO1104 cDNA, wherein SEQ ID NO:223 is a clone designated herein as "DNA59616-1465".

FIG. 224 shows the amino acid sequence (SEQ ID NO:224) derived from the coding sequence of SEQ ID NO:223 shown in FIG. 223.

FIG. 225 shows a nucleotide sequence (SEQ ID NO:225) of a native sequence PRO1100 cDNA, wherein SEQ ID NO:225 is a clone designated herein as "DNA59619-1464".

FIG. 226 shows the amino acid sequence (SEQ ID NO:226) derived from the coding sequence of SEQ ID NO:225 shown in FIG. 225.

FIG. 227 shows a nucleotide sequence (SEQ ID NO:227) of a native sequence PRO1141 cDNA, wherein SEQ ID NO:227 is a clone designated herein as "DNA59625-1498".

FIG. 228 shows the amino acid sequence (SEQ ID NO:228) derived from the coding sequence of SEQ ID NO:227 shown in FIG. 227.

FIG. 229 shows a nucleotide sequence (SEQ ID NO:229) of a native sequence PRO1772 cDNA, wherein SEQ ID NO:229 is a clone designated herein as "DNA59817-1703".

FIG. 230 shows the amino acid sequence (SEQ ID NO:230) derived from the coding sequence of SEQ ID NO:229 shown in FIG. 229.

FIG. 231 shows a nucleotide sequence (SEQ ID NO:231) of a native sequence PRO1064 cDNA, wherein SEQ ID NO:231 is a clone designated herein as "DNA59827-1426".

FIG. 232 shows the amino acid sequence (SEQ ID NO:232) derived from the coding sequence of SEQ ID NO:231 shown in FIG. 231.

FIG. 233 shows a nucleotide sequence (SEQ ID NO:233) of a native sequence PRO1379 cDNA, wherein SEQ ID NO:233 is a clone designated herein as “DNA59828-1608”.

FIG. 234 shows the amino acid sequence (SEQ ID NO:234) derived from the coding sequence of SEQ ID NO:233 shown in FIG. 233.

FIG. 235 shows a nucleotide sequence (SEQ ID NO:235) of a native sequence PRO3573 cDNA, wherein SEQ ID NO:235 is a clone designated herein as “DNA59837-2545”.

FIG. 236 shows the amino acid sequence (SEQ ID NO:236) derived from the coding sequence of SEQ ID NO:235 shown in FIG. 235.

FIG. 237 shows a nucleotide sequence (SEQ ID NO:237) of a native sequence PRO3566 cDNA, wherein SEQ ID NO:237 is a clone designated herein as “DNA59844-2542”.

FIG. 238 shows the amino acid sequence (SEQ ID NO:238) derived from the coding sequence of SEQ ID NO:237 shown in FIG. 237.

FIG. 239 shows a nucleotide sequence (SEQ ID NO:239) of a native sequence PRO1156 cDNA, wherein SEQ ID NO:239 is a clone designated herein as “DNA59853-1505”.

FIG. 240 shows the amino acid sequence (SEQ ID NO:240) derived from the coding sequence of SEQ ID NO:239 shown in FIG. 239.

FIG. 241 shows a nucleotide sequence (SEQ ID NO:241) of a native sequence PRO1098 cDNA, wherein SEQ ID NO:241 is a clone designated herein as “DNA59854-1459”.

FIG. 242 shows the amino acid sequence (SEQ ID NO:242) derived from the coding sequence of SEQ ID NO:241 shown in FIG. 241.

FIG. 243 shows a nucleotide sequence (SEQ ID NO:243) of a native sequence PRO1128 cDNA, wherein SEQ ID NO:243 is a clone designated herein as “DNA59855-1485”.

FIG. 244 shows the amino acid sequence (SEQ ID NO:244) derived from the coding sequence of SEQ ID NO:243 shown in FIG. 243.

FIG. 245 shows a nucleotide sequence (SEQ ID NO:245) of a native sequence PRO1248 cDNA, wherein SEQ ID NO:245 is a clone designated herein as “DNA60278-1530”.

FIG. 246 shows the amino acid sequence (SEQ ID NO:246) derived from the coding sequence of SEQ ID NO:245 shown in FIG. 245.

FIG. 247 shows a nucleotide sequence (SEQ ID NO:247) of a native sequence PRO1127 cDNA, wherein SEQ ID NO:247 is a clone designated herein as “DNA60283-1484”.

FIG. 248 shows the amino acid sequence (SEQ ID NO:248) derived from the coding sequence of SEQ ID NO:247 shown in FIG. 247.

FIG. 249 shows a nucleotide sequence (SEQ ID NO:249) of a native sequence PRO1316 cDNA, wherein SEQ ID NO:249 is a clone designated herein as “DNA60608-1577”.

FIG. 250 shows the amino acid sequence (SEQ ID NO:250) derived from the coding sequence of SEQ ID NO:249 shown in FIG. 249.

FIG. 251 shows a nucleotide sequence (SEQ ID NO:251) of a native sequence PRO1197 cDNA, wherein SEQ ID NO:251 is a clone designated herein as “DNA60611-1524”.

FIG. 252 shows the amino acid sequence (SEQ ID NO:252) derived from the coding sequence of SEQ ID NO:251 shown in FIG. 251.

FIG. 253 shows a nucleotide sequence (SEQ ID NO:253) of a native sequence PRO1125 cDNA, wherein SEQ ID NO:253 is a clone designated herein as “DNA60619-1482”.

FIG. 254 shows the amino acid sequence (SEQ ID NO:254) derived from the coding sequence of SEQ ID NO:253 shown in FIG. 253.

FIG. 255 shows a nucleotide sequence (SEQ ID NO:255) of a native sequence PRO1158 cDNA, wherein SEQ ID NO:255 is a clone designated herein as “DNA60625-1507”.

FIG. 256 shows the amino acid sequence (SEQ ID NO:256) derived from the coding sequence of SEQ ID NO:255 shown in FIG. 255.

FIG. 257 shows a nucleotide sequence (SEQ ID NO:257) of a native sequence PRO1124 cDNA, wherein SEQ ID NO:257 is a clone designated herein as “DNA60629-1481”.

FIG. 258 shows the amino acid sequence (SEQ ID NO:258) derived from the coding sequence of SEQ ID NO:257 shown in FIG. 257.

FIG. 259 shows a nucleotide sequence (SEQ ID NO:259) of a native sequence PRO1380 cDNA, wherein SEQ ID NO:259 is a clone designated herein as “DNA60740-1615”.

FIG. 260 shows the amino acid sequence (SEQ ID NO:260) derived from the coding sequence of SEQ ID NO:259 shown in FIG. 259.

FIG. 261 shows a nucleotide sequence (SEQ ID NO:261) of a native sequence PRO1377 cDNA, wherein SEQ ID NO:261 is a clone designated herein as “DNA61608-1606”.

FIG. 262 shows the amino acid sequence (SEQ ID NO:262) derived from the coding sequence of SEQ ID NO:261 shown in FIG. 261.

FIG. 263 shows a nucleotide sequence (SEQ ID NO:263) of a native sequence PRO1287 cDNA, wherein SEQ ID NO:263 is a clone designated herein as “DNA61755-1554”.

FIG. 264 shows the amino acid sequence (SEQ ID NO:264) derived from the coding sequence of SEQ ID NO:263 shown in FIG. 263.

FIG. 265 shows a nucleotide sequence (SEQ ID NO:265) of a native sequence PRO1249 cDNA, wherein SEQ ID NO:265 is a clone designated herein as “DNA62809-1531”.

FIG. 266 shows the amino acid sequence (SEQ ID NO:266) derived from the coding sequence of SEQ ID NO:265 shown in FIG. 265.

FIG. 267 shows a nucleotide sequence (SEQ ID NO:267) of a native sequence PRO1335 cDNA, wherein SEQ ID NO:267 is a clone designated herein as “DNA62812-1594”.

FIG. 268 shows the amino acid sequence (SEQ ID NO:268) derived from the coding sequence of SEQ ID NO:267 shown in FIG. 267.

FIG. 269 shows a nucleotide sequence (SEQ ID NO:269) of a native sequence PRO3572 cDNA, wherein SEQ ID NO:269 is a clone designated herein as “DNA62813-2544”.

FIG. 270 shows the amino acid sequence (SEQ ID NO:270) derived from the coding sequence of SEQ ID NO:269 shown in FIG. 269.

FIG. 271 shows a nucleotide sequence (SEQ ID NO:271) of a native sequence PRO1599 cDNA, wherein SEQ ID NO:271 is a clone designated herein as “DNA62845-1684”.

FIG. 272 shows the amino acid sequence (SEQ ID NO:272) derived from the coding sequence of SEQ ID NO:271 shown in FIG. 271.

FIG. 273 shows a nucleotide sequence (SEQ ID NO:273) of a native sequence PRO1374 cDNA, wherein SEQ ID NO:273 is a clone designated herein as “DNA64849-1604”.

FIG. 274 shows the amino acid sequence (SEQ ID NO:274) derived from the coding sequence of SEQ ID NO:273 shown in FIG. 273.

FIG. 275 shows a nucleotide sequence (SEQ ID NO:275) of a native sequence PRO1345 cDNA, wherein SEQ ID NO:275 is a clone designated herein as “DNA64852-1589”.

FIG. 276 shows the amino acid sequence (SEQ ID NO:276) derived from the coding sequence of SEQ ID NO:275 shown in FIG. 275.

FIG. 277 shows a nucleotide sequence (SEQ ID NO:277) of a native sequence PRO1311 cDNA, wherein SEQ ID NO:277 is a clone designated herein as "DNA64863-1573".

FIG. 278 shows the amino acid sequence (SEQ ID NO:278) derived from the coding sequence of SEQ ID NO:277 shown in FIG. 277.

FIG. 279 shows a nucleotide sequence (SEQ ID NO:279) of a native sequence PRO1357 cDNA, wherein SEQ ID NO:279 is a clone designated herein as "DNA64881-1602".

FIG. 280 shows the amino acid sequence (SEQ ID NO:280) derived from the coding sequence of SEQ ID NO:279 shown in FIG. 279.

FIG. 281 shows a nucleotide sequence (SEQ ID NO:281) of a native sequence PRO1557 cDNA, wherein SEQ ID NO:281 is a clone designated herein as "DNA64902-1667".

FIG. 282 shows the amino acid sequence (SEQ ID NO:282) derived from the coding sequence of SEQ ID NO:281 shown in FIG. 281.

FIG. 283 shows a nucleotide sequence (SEQ ID NO:283) of a native sequence PRO1305 cDNA, wherein SEQ ID NO:283 is a clone designated herein as "DNA64952-1568".

FIG. 284 shows the amino acid sequence (SEQ ID NO:284) derived from the coding sequence of SEQ ID NO:283 shown in FIG. 283.

FIG. 285 shows a nucleotide sequence (SEQ ID NO:285) of a native sequence PRO1302 cDNA, wherein SEQ ID NO:285 is a clone designated herein as "DNA65403-1565".

FIG. 286 shows the amino acid sequence (SEQ ID NO:286) derived from the coding sequence of SEQ ID NO:285 shown in FIG. 285.

FIG. 287 shows a nucleotide sequence (SEQ ID NO:287) of a native sequence PRO1266 cDNA, wherein SEQ ID NO:287 is a clone designated herein as "DNA65413-1534".

FIG. 288 shows the amino acid sequence (SEQ ID NO:288) derived from the coding sequence of SEQ ID NO:287 shown in FIG. 287.

FIGS. 289A-289B show a nucleotide sequence (SEQ ID NO:289) of a native sequence PRO1336 cDNA, wherein SEQ ID NO:289 is a clone designated herein as "DNA65423-1595".

FIG. 290 shows the amino acid sequence (SEQ ID NO:290) derived from the coding sequence of SEQ ID NO:289 shown in FIGS. 289A-289B.

FIG. 291 shows a nucleotide sequence (SEQ ID NO:291) of a native sequence PRO1278 cDNA, wherein SEQ ID NO:291 is a clone designated herein as "DNA66304-1546".

FIG. 292 shows the amino acid sequence (SEQ ID NO:292) derived from the coding sequence of SEQ ID NO:291 shown in FIG. 291.

FIG. 293 shows a nucleotide sequence (SEQ ID NO:293) of a native sequence PRO1270 cDNA, wherein SEQ ID NO:293 is a clone designated herein as "DNA66308-1537".

FIG. 294 shows the amino acid sequence (SEQ ID NO:294) derived from the coding sequence of SEQ ID NO:293 shown in FIG. 293.

FIG. 295 shows a nucleotide sequence (SEQ ID NO:295) of a native sequence PRO1298 cDNA, wherein SEQ ID NO:295 is a clone designated herein as "DNA66511-1563".

FIG. 296 shows the amino acid sequence (SEQ ID NO:296) derived from the coding sequence of SEQ ID NO:295 shown in FIG. 295.

FIG. 297 shows a nucleotide sequence (SEQ ID NO:297) of a native sequence PRO1301 cDNA, wherein SEQ ID NO:297 is a clone designated herein as "DNA66512-1564".

FIG. 298 shows the amino acid sequence (SEQ ID NO:298) derived from the coding sequence of SEQ ID NO:297 shown in FIG. 297.

FIG. 299 shows a nucleotide sequence (SEQ ID NO:299) of a native sequence PRO1268 cDNA, wherein SEQ ID NO:299 is a clone designated herein as "DNA66519-1535".

FIG. 300 shows the amino acid sequence (SEQ ID NO:300) derived from the coding sequence of SEQ ID NO:299 shown in FIG. 299.

FIG. 301 shows a nucleotide sequence (SEQ ID NO:301) of a native sequence PRO1327 cDNA, wherein SEQ ID NO:301 is a clone designated herein as "DNA66521-1583".

FIG. 302 shows the amino acid sequence (SEQ ID NO:302) derived from the coding sequence of SEQ ID NO:301 shown in FIG. 301.

FIG. 303 shows a nucleotide sequence (SEQ ID NO:303) of a native sequence PRO1328 cDNA, wherein SEQ ID NO:303 is a clone designated herein as "DNA66658-1584".

FIG. 304 shows the amino acid sequence (SEQ ID NO:304) derived from the coding sequence of SEQ ID NO:303 shown in FIG. 303.

FIG. 305 shows a nucleotide sequence (SEQ ID NO:305) of a native sequence PRO1329 cDNA, wherein SEQ ID NO:305 is a clone designated herein as "DNA66660-1585".

FIG. 306 shows the amino acid sequence (SEQ ID NO:306) derived from the coding sequence of SEQ ID NO:305 shown in FIG. 305.

FIG. 307 shows a nucleotide sequence (SEQ ID NO:307) of a native sequence PRO1339 cDNA, wherein SEQ ID NO:307 is a clone designated herein as "DNA66669-1597".

FIG. 308 shows the amino acid sequence (SEQ ID NO:308) derived from the coding sequence of SEQ ID NO:307 shown in FIG. 307.

FIG. 309 shows a nucleotide sequence (SEQ ID NO:309) of a native sequence PRO1342 cDNA, wherein SEQ ID NO:309 is a clone designated herein as "DNA66674-1599".

FIG. 310 shows the amino acid sequence (SEQ ID NO:310) derived from the coding sequence of SEQ ID NO:309 shown in FIG. 309.

FIGS. 311A-311B show a nucleotide sequence (SEQ ID NO:311) of a native sequence PRO1487 cDNA, wherein SEQ ID NO:311 is a clone designated herein as "DNA68836-1656".

FIG. 312 shows the amino acid sequence (SEQ ID NO:312) derived from the coding sequence of SEQ ID NO:311 shown in FIGS. 311A-311B.

FIG. 313 shows a nucleotide sequence (SEQ ID NO:313) of a native sequence PRO3579 cDNA, wherein SEQ ID NO:313 is a clone designated herein as "DNA68862-2546".

FIG. 314 shows the amino acid sequence (SEQ ID NO:314) derived from the coding sequence of SEQ ID NO:313 shown in FIG. 313.

FIG. 315 shows a nucleotide sequence (SEQ ID NO:315) of a native sequence PRO1472 cDNA, wherein SEQ ID NO:315 is a clone designated herein as "DNA68866-1644".

FIG. 316 shows the amino acid sequence (SEQ ID NO:316) derived from the coding sequence of SEQ ID NO:315 shown in FIG. 315.

FIG. 317 shows a nucleotide sequence (SEQ ID NO:317) of a native sequence PRO1385 cDNA, wherein SEQ ID NO:317 is a clone designated herein as "DNA68869-1610".

FIG. 318 shows the amino acid sequence (SEQ ID NO:318) derived from the coding sequence of SEQ ID NO:317 shown in FIG. 317.

FIG. 319 shows a nucleotide sequence (SEQ ID NO:319) of a native sequence PRO1461 cDNA, wherein SEQ ID NO:319 is a clone designated herein as "DNA68871-1638".

FIG. 320 shows the amino acid sequence (SEQ ID NO:320) derived from the coding sequence of SEQ ID NO:319 shown in FIG. 319.

FIG. 321 shows a nucleotide sequence (SEQ ID NO:321) of a native sequence PRO1429 cDNA, wherein SEQ ID NO:321 is a clone designated herein as "DNA68879-1631".

FIG. 322 shows the amino acid sequence (SEQ ID NO:322) derived from the coding sequence of SEQ ID NO:321 shown in FIG. 321.

FIG. 323 shows a nucleotide sequence (SEQ ID NO:323) of a native sequence PRO1568 cDNA, wherein SEQ ID NO:323 is a clone designated herein as "DNA68880-1676".

FIG. 324 shows the amino acid sequence (SEQ ID NO:324) derived from the coding sequence of SEQ ID NO:323 shown in FIG. 323.

FIG. 325 shows a nucleotide sequence (SEQ ID NO:325) of a native sequence PRO1569 cDNA, wherein SEQ ID NO:325 is a clone designated herein as "DNA68882-1677".

FIG. 326 shows the amino acid sequence (SEQ ID NO:326) derived from the coding sequence of SEQ ID NO:325 shown in FIG. 325.

FIG. 327 shows a nucleotide sequence (SEQ ID NO:327) of a native sequence PRO1753 cDNA, wherein SEQ ID NO:327 is a clone designated herein as "DNA68883-1691".

FIG. 328 shows the amino acid sequence (SEQ ID NO:328) derived from the coding sequence of SEQ ID NO:327 shown in FIG. 327.

FIG. 329 shows a nucleotide sequence (SEQ ID NO:329) of a native sequence PRO1570 cDNA, wherein SEQ ID NO:329 is a clone designated herein as "DNA68885-1678".

FIG. 330 shows the amino acid sequence (SEQ ID NO:330) derived from the coding sequence of SEQ ID NO:329 shown in FIG. 329.

FIG. 331 shows a nucleotide sequence (SEQ ID NO:331) of a native sequence PRO1559 cDNA, wherein SEQ ID NO:331 is a clone designated herein as "DNA68886".

FIG. 332 shows the amino acid sequence (SEQ ID NO:332) derived from the coding sequence of SEQ ID NO:331 shown in FIG. 331.

FIG. 333 shows a nucleotide sequence (SEQ ID NO:333) of a native sequence PRO1486 cDNA, wherein SEQ ID NO:333 is a clone designated herein as "DNA71180-1655".

FIG. 334 shows the amino acid sequence (SEQ ID NO:334) derived from the coding sequence of SEQ ID NO:333 shown in FIG. 333.

FIG. 335 shows a nucleotide sequence (SEQ ID NO:335) of a native sequence PRO1433 cDNA, wherein SEQ ID NO:335 is a clone designated herein as "DNA71184-1634".

FIG. 336 shows the amino acid sequence (SEQ ID NO:336) derived from the coding sequence of SEQ ID NO:335 shown in FIG. 335.

FIG. 337 shows a nucleotide sequence (SEQ ID NO:337) of a native sequence PRO1490 cDNA, wherein SEQ ID NO:337 is a clone designated herein as "DNA71213-1659".

FIG. 338 shows the amino acid sequence (SEQ ID NO:338) derived from the coding sequence of SEQ ID NO:337 shown in FIG. 337.

FIG. 339 shows a nucleotide sequence (SEQ ID NO:339) of a native sequence PRO1482 cDNA, wherein SEQ ID NO:339 is a clone designated herein as "DNA71234-1651".

FIG. 340 shows the amino acid sequence (SEQ ID NO:340) derived from the coding sequence of SEQ ID NO:339 shown in FIG. 339.

FIG. 341 shows a nucleotide sequence (SEQ ID NO:341) of a native sequence PRO1409 cDNA, wherein SEQ ID NO:341 is a clone designated herein as "DNA71269-1621".

FIG. 342 shows the amino acid sequence (SEQ ID NO:342) derived from the coding sequence of SEQ ID NO:341 shown in FIG. 341.

FIG. 343 shows a nucleotide sequence (SEQ ID NO:343) of a native sequence PRO1446 cDNA, wherein SEQ ID NO:343 is a clone designated herein as "DNA71277-1636".

FIG. 344 shows the amino acid sequence (SEQ ID NO:344) derived from the coding sequence of SEQ ID NO:343 shown in FIG. 343.

FIG. 345 shows a nucleotide sequence (SEQ ID NO:345) of a native sequence PRO1604 cDNA, wherein SEQ ID NO:345 is a clone designated herein as "DNA71286-1687".

FIG. 346 shows the amino acid sequence (SEQ ID NO:346) derived from the coding sequence of SEQ ID NO:345 shown in FIG. 345.

FIG. 347 shows a nucleotide sequence (SEQ ID NO:347) of a native sequence PRO1491 cDNA, wherein SEQ ID NO:347 is a clone designated herein as "DNA71883-1660".

FIG. 348 shows the amino acid sequence (SEQ ID NO:348) derived from the coding sequence of SEQ ID NO:347 shown in FIG. 347.

FIG. 349 shows a nucleotide sequence (SEQ ID NO:349) of a native sequence PRO1431 cDNA, wherein SEQ ID NO:349 is a clone designated herein as "DNA73401-1633".

FIG. 350 shows the amino acid sequence (SEQ ID NO:350) derived from the coding sequence of SEQ ID NO:349 shown in FIG. 349.

FIGS. 351A-351B show a nucleotide sequence (SEQ ID NO:351) of a native sequence PRO1563 cDNA, wherein SEQ ID NO:351 is a clone designated herein as "DNA73492-1671".

FIG. 352 shows the amino acid sequence (SEQ ID NO:352) derived from the coding sequence of SEQ ID NO:351 shown in FIGS. 351A-351B.

FIG. 353 shows a nucleotide sequence (SEQ ID NO:353) of a native sequence PRO1571 cDNA, wherein SEQ ID NO:353 is a clone designated herein as "DNA73730-1679".

FIG. 354 shows the amino acid sequence (SEQ ID NO:354) derived from the coding sequence of SEQ ID NO:353 shown in FIG. 353.

FIG. 355 shows a nucleotide sequence (SEQ ID NO:355) of a native sequence PRO1572 cDNA, wherein SEQ ID NO:355 is a clone designated herein as "DNA73734-1680".

FIG. 356 shows the amino acid sequence (SEQ ID NO:356) derived from the coding sequence of SEQ ID NO:355 shown in FIG. 355.

FIG. 357 shows a nucleotide sequence (SEQ ID NO:357) of a native sequence PRO1573 cDNA, wherein SEQ ID NO:357 is a clone designated herein as "DNA73735-1681".

FIG. 358 shows the amino acid sequence (SEQ ID NO:358) derived from the coding sequence of SEQ ID NO:357 shown in FIG. 357.

FIG. 359 shows a nucleotide sequence (SEQ ID NO:359) of a native sequence PRO1508 cDNA, wherein SEQ ID NO:359 is a clone designated herein as "DNA73742-1662".

FIG. 360 shows the amino acid sequence (SEQ ID NO:360) derived from the coding sequence of SEQ ID NO:359 shown in FIG. 359.

FIG. 361 shows a nucleotide sequence (SEQ ID NO:361) of a native sequence PRO1485 cDNA, wherein SEQ ID NO:361 is a clone designated herein as "DNA73746-1654".

FIG. 362 shows the amino acid sequence (SEQ ID NO:362) derived from the coding sequence of SEQ ID NO:361 shown in FIG. 361.

FIG. 363 shows a nucleotide sequence (SEQ ID NO:363) of a native sequence PRO1564 cDNA, wherein SEQ ID NO:363 is a clone designated herein as "DNA73760-1672".

FIG. 364 shows the amino acid sequence (SEQ ID NO:364) derived from the coding sequence of SEQ ID NO:363 shown in FIG. 363.

FIG. 365 shows a nucleotide sequence (SEQ ID NO:365) of a native sequence PRO1550 cDNA, wherein SEQ ID NO:365 is a clone designated herein as "DNA76393-1664".

FIG. 366 shows the amino acid sequence (SEQ ID NO:366) derived from the coding sequence of SEQ ID NO:365 shown in FIG. 365.

FIG. 367 shows a nucleotide sequence (SEQ ID NO:367) of a native sequence PRO1757 cDNA, wherein SEQ ID NO:367 is a clone designated herein as "DNA76398-1699".

FIG. 368 shows the amino acid sequence (SEQ ID NO:368) derived from the coding sequence of SEQ ID NO:367 shown in FIG. 367.

FIG. 369 shows a nucleotide sequence (SEQ ID NO:369) of a native sequence PRO1758 cDNA, wherein SEQ ID NO:369 is a clone designated herein as "DNA76399-1700".

FIG. 370 shows the amino acid sequence (SEQ ID NO:370) derived from the coding sequence of SEQ ID NO:369 shown in FIG. 369.

FIG. 371 shows a nucleotide sequence (SEQ ID NO:371) of a native sequence PRO1781 cDNA, wherein SEQ ID NO:371 is a clone designated herein as "DNA76522-2500".

FIG. 372 shows the amino acid sequence (SEQ ID NO:372) derived from the coding sequence of SEQ ID NO:371 shown in FIG. 371.

FIG. 373 shows a nucleotide sequence (SEQ ID NO:373) of a native sequence PRO1606 cDNA, wherein SEQ ID NO:373 is a clone designated herein as "DNA76533-1689".

FIG. 374 shows the amino acid sequence (SEQ ID NO:374) derived from the coding sequence of SEQ ID NO:373 shown in FIG. 373.

FIG. 375 shows a nucleotide sequence (SEQ ID NO:375) of a native sequence PRO1784 cDNA, wherein SEQ ID NO:375 is a clone designated herein as "DNA77303-2502".

FIG. 376 shows the amino acid sequence (SEQ ID NO:376) derived from the coding sequence of SEQ ID NO:375 shown in FIG. 375.

FIG. 377 shows a nucleotide sequence (SEQ ID NO:377) of a native sequence PRO1774 cDNA, wherein SEQ ID NO:377 is a clone designated herein as "DNA77626-1705".

FIG. 378 shows the amino acid sequence (SEQ ID NO:378) derived from the coding sequence of SEQ ID NO:377 shown in FIG. 377.

FIG. 379 shows a nucleotide sequence (SEQ ID NO:379) of a native sequence PRO1605 cDNA, wherein SEQ ID NO:379 is a clone designated herein as "DNA77648-1688".

FIG. 380 shows the amino acid sequence (SEQ ID NO:380) derived from the coding sequence of SEQ ID NO:379 shown in FIG. 379.

FIG. 381 shows a nucleotide sequence (SEQ ID NO:381) of a native sequence PRO1928 cDNA, wherein SEQ ID NO:381 is a clone designated herein as "DNA81754-2532".

FIG. 382 shows the amino acid sequence (SEQ ID NO:382) derived from the coding sequence of SEQ ID NO:381 shown in FIG. 381.

FIG. 383 shows a nucleotide sequence (SEQ ID NO:383) of a native sequence PRO1865 cDNA, wherein SEQ ID NO:383 is a clone designated herein as "DNA81757-2512".

FIG. 384 shows the amino acid sequence (SEQ ID NO:384) derived from the coding sequence of SEQ ID NO:383 shown in FIG. 383.

FIG. 385 shows a nucleotide sequence (SEQ ID NO:385) of a native sequence PRO1925 cDNA, wherein SEQ ID NO:385 is a clone designated herein as "DNA82302-2529".

FIG. 386 shows the amino acid sequence (SEQ ID NO:386) derived from the coding sequence of SEQ ID NO:385 shown in FIG. 385.

FIG. 387 shows a nucleotide sequence (SEQ ID NO:387) of a native sequence PRO1926 cDNA, wherein SEQ ID NO:387 is a clone designated herein as "DNA82340-2530".

FIG. 388 shows the amino acid sequence (SEQ ID NO:388) derived from the coding sequence of SEQ ID NO:387 shown in FIG. 387.

FIG. 389 shows a nucleotide sequence (SEQ ID NO:389) of a native sequence PRO2630 cDNA, wherein SEQ ID NO:389 is a clone designated herein as "DNA83551".

FIG. 390 shows the amino acid sequence (SEQ ID NO:390) derived from the coding sequence of SEQ ID NO:389 shown in FIG. 389.

FIG. 391 shows a nucleotide sequence (SEQ ID NO:391) of a native sequence PRO3443 cDNA, wherein SEQ ID NO:391 is a clone designated herein as "DNA87991-2540".

FIG. 392 shows the amino acid sequence (SEQ ID NO:392) derived from the coding sequence of SEQ ID NO:391 shown in FIG. 391.

FIG. 393 shows a nucleotide sequence (SEQ ID NO:393) of a native sequence PRO3301 cDNA, wherein SEQ ID NO:393 is a clone designated herein as "DNA88002".

FIG. 394 shows the amino acid sequence (SEQ ID NO:394) derived from the coding sequence of SEQ ID NO:393 shown in FIG. 393.

FIG. 395 shows a nucleotide sequence (SEQ ID NO:395) of a native sequence PRO3442 cDNA, wherein SEQ ID NO:395 is a clone designated herein as "DNA92238-2539".

FIG. 396 shows the amino acid sequence (SEQ ID NO:396) derived from the coding sequence of SEQ ID NO:395 shown in FIG. 395.

FIG. 397 shows a nucleotide sequence (SEQ ID NO:397) of a native sequence PRO4978 cDNA, wherein SEQ ID NO:397 is a clone designated herein as "DNA95930".

FIG. 398 shows the amino acid sequence (SEQ ID NO:398) derived from the coding sequence of SEQ ID NO:397 shown in FIG. 397.

FIG. 399 shows a nucleotide sequence (SEQ ID NO:399) of a native sequence PRO5801 cDNA, wherein SEQ ID NO:399 is a clone designated herein as "DNA115291-2681".

FIG. 400 shows the amino acid sequence (SEQ ID NO:400) derived from the coding sequence of SEQ ID NO:399 shown in FIG. 399.

FIG. 401 shows a nucleotide sequence (SEQ ID NO:401) of a native sequence PRO19630 cDNA, wherein SEQ ID NO:401 is a clone designated herein as "DNA23336-2861".

FIG. 402 shows the amino acid sequence (SEQ ID NO:402) derived from the coding sequence of SEQ ID NO:401 shown in FIG. 401.

FIG. 403 shows a nucleotide sequence (SEQ ID NO:403) of a native sequence PRO203 cDNA, wherein SEQ ID NO:403 is a clone designated herein as "DNA30862-1396".

FIG. 404 shows the amino acid sequence (SEQ ID NO:404) derived from the coding sequence of SEQ ID NO:403 shown in FIG. 403.

FIG. 405 shows a nucleotide sequence (SEQ ID NO:405) of a native sequence PRO204 cDNA, wherein SEQ ID NO:405 is a clone designated herein as "DNA30871-1157".

FIG. 406 shows the amino acid sequence (SEQ ID NO:406) derived from the coding sequence of SEQ ID NO:405 shown in FIG. 405.

FIG. 407 shows a nucleotide sequence (SEQ ID NO:407) of a native sequence PRO210 cDNA, wherein SEQ ID NO:407 is a clone designated herein as "DNA32279-1131".

FIG. 408 shows the amino acid sequence (SEQ ID NO:408) derived from the coding sequence of SEQ ID NO:407 shown in FIG. 407.

FIG. 409 shows a nucleotide sequence (SEQ ID NO:409) of a native sequence PRO223 cDNA, wherein SEQ ID NO:409 is a clone designated herein as "DNA33206-1165".

FIG. 410 shows the amino acid sequence (SEQ ID NO:410) derived from the coding sequence of SEQ ID NO:409 shown in FIG. 409.

FIG. 411 shows a nucleotide sequence (SEQ ID NO:411) of a native sequence PRO247 cDNA, wherein SEQ ID NO:411 is a clone designated herein as "DNA35673-1201".

FIG. 412 shows the amino acid sequence (SEQ ID NO:412) derived from the coding sequence of SEQ ID NO:411 shown in FIG. 411.

FIG. 413 shows a nucleotide sequence (SEQ ID NO:413) of a native sequence PRO358 cDNA, wherein SEQ ID NO:413 is a clone designated herein as "DNA47361-1154-2".

FIG. 414 shows the amino acid sequence (SEQ ID NO:414) derived from the coding sequence of SEQ ID NO:413 shown in FIG. 413.

FIG. 415 shows a nucleotide sequence (SEQ ID NO:415) of a native sequence PRO724 cDNA, wherein SEQ ID NO:415 is a clone designated herein as "DNA49631-1328".

FIG. 416 shows the amino acid sequence (SEQ ID NO:416) derived from the coding sequence of SEQ ID NO:415 shown in FIG. 415.

FIG. 417 shows a nucleotide sequence (SEQ ID NO:417) of a native sequence PRO868 cDNA, wherein SEQ ID NO:417 is a clone designated herein as "DNA52594-1270".

FIG. 418 shows the amino acid sequence (SEQ ID NO:418) derived from the coding sequence of SEQ ID NO:417 shown in FIG. 417.

FIG. 419 shows a nucleotide sequence (SEQ ID NO:419) of a native sequence PRO740 cDNA, wherein SEQ ID NO:419 is a clone designated herein as "DNA55800-1263".

FIG. 420 shows the amino acid sequence (SEQ ID NO:420) derived from the coding sequence of SEQ ID NO:419 shown in FIG. 419.

FIG. 421 shows a nucleotide sequence (SEQ ID NO:421) of a native sequence PRO1478 cDNA, wherein SEQ ID NO:421 is a clone designated herein as "DNA56531-1648".

FIG. 422 shows the amino acid sequence (SEQ ID NO:422) derived from the coding sequence of SEQ ID NO:421 shown in FIG. 421.

FIG. 423 shows a nucleotide sequence (SEQ ID NO:423) of a native sequence PRO162 cDNA, wherein SEQ ID NO:423 is a clone designated herein as "DNA56965-1356".

FIG. 424 shows the amino acid sequence (SEQ ID NO:424) derived from the coding sequence of SEQ ID NO:423 shown in FIG. 423.

FIG. 425 shows a nucleotide sequence (SEQ ID NO:425) of a native sequence PRO828 cDNA, wherein SEQ ID NO:425 is a clone designated herein as "DNA57037-1444".

FIG. 426 shows the amino acid sequence (SEQ ID NO:426) derived from the coding sequence of SEQ ID NO:425 shown in FIG. 425.

FIG. 427 shows a nucleotide sequence (SEQ ID NO:427) of a native sequence PRO819 cDNA, wherein SEQ ID NO:427 is a clone designated herein as "DNA57695-1340".

FIG. 428 shows the amino acid sequence (SEQ ID NO:428) derived from the coding sequence of SEQ ID NO:427 shown in FIG. 427.

FIG. 429 shows a nucleotide sequence (SEQ ID NO:429) of a native sequence PRO813 cDNA, wherein SEQ ID NO:429 is a clone designated herein as "DNA57834-1339".

FIG. 430 shows the amino acid sequence (SEQ ID NO:430) derived from the coding sequence of SEQ ID NO:429 shown in FIG. 429.

FIG. 431 shows a nucleotide sequence (SEQ ID NO:431) of a native sequence PRO1194 cDNA, wherein SEQ ID NO:431 is a clone designated herein as "DNA57841-1522".

FIG. 432 shows the amino acid sequence (SEQ ID NO:432) derived from the coding sequence of SEQ ID NO:431 shown in FIG. 431.

FIG. 433 shows a nucleotide sequence (SEQ ID NO:433) of a native sequence PRO887 cDNA, wherein SEQ ID NO:433 is a clone designated herein as "DNA58130".

FIG. 434 shows the amino acid sequence (SEQ ID NO:434) derived from the coding sequence of SEQ ID NO:433 shown in FIG. 433.

FIG. 435 shows a nucleotide sequence (SEQ ID NO:435) of a native sequence PRO1071 cDNA, wherein SEQ ID NO:435 is a clone designated herein as "DNA58847-1383".

FIG. 436 shows the amino acid sequence (SEQ ID NO:436) derived from the coding sequence of SEQ ID NO:435 shown in FIG. 435.

FIG. 437 shows a nucleotide sequence (SEQ ID NO:437) of a native sequence PRO1029 cDNA, wherein SEQ ID NO:437 is a clone designated herein as "DNA59493-1420".

FIG. 438 shows the amino acid sequence (SEQ ID NO:438) derived from the coding sequence of SEQ ID NO:437 shown in FIG. 437.

FIG. 439 shows a nucleotide sequence (SEQ ID NO:439) of a native sequence PRO1190 cDNA, wherein SEQ ID NO:439 is a clone designated herein as "DNA59586-1520".

FIG. 440 shows the amino acid sequence (SEQ ID NO:440) derived from the coding sequence of SEQ ID NO:439 shown in FIG. 439.

FIG. 441 shows a nucleotide sequence (SEQ ID NO:441) of a native sequence PRO4334 cDNA, wherein SEQ ID NO:441 is a clone designated herein as "DNA59608-2577".

FIG. 442 shows the amino acid sequence (SEQ ID NO:442) derived from the coding sequence of SEQ ID NO:441 shown in FIG. 441.

FIG. 443 shows a nucleotide sequence (SEQ ID NO:443) of a native sequence PRO1155 cDNA, wherein SEQ ID NO:443 is a clone designated herein as "DNA59849-1504".

FIG. 444 shows the amino acid sequence (SEQ ID NO:444) derived from the coding sequence of SEQ ID NO:443 shown in FIG. 443.

FIG. 445 shows a nucleotide sequence (SEQ ID NO:445) of a native sequence PRO1157 cDNA, wherein SEQ ID NO:445 is a clone designated herein as "DNA60292-1506".

FIG. 446 shows the amino acid sequence (SEQ ID NO:446) derived from the coding sequence of SEQ ID NO:445 shown in FIG. 445.

FIG. 447 shows a nucleotide sequence (SEQ ID NO:447) of a native sequence PRO1122 cDNA, wherein SEQ ID NO:447 is a clone designated herein as "DNA62377-1381-1".

FIG. 448 shows the amino acid sequence (SEQ ID NO:448) derived from the coding sequence of SEQ ID NO:447 shown in FIG. 447.

FIG. 449 shows a nucleotide sequence (SEQ ID NO:449) of a native sequence PRO1183 cDNA, wherein SEQ ID NO:449 is a clone designated herein as "DNA62880-1513".

FIG. 450 shows the amino acid sequence (SEQ ID NO:450) derived from the coding sequence of SEQ ID NO:449 shown in FIG. 449.

FIG. 451 shows a nucleotide sequence (SEQ ID NO:451) of a native sequence PRO1337 cDNA, wherein SEQ ID NO:451 is a clone designated herein as "DNA66672-1586".

FIG. 452 shows the amino acid sequence (SEQ ID NO:452) derived from the coding sequence of SEQ ID NO:451 shown in FIG. 451.

FIG. 453 shows a nucleotide sequence (SEQ ID NO:453) of a native sequence PRO1480 cDNA, wherein SEQ ID NO:453 is a clone designated herein as “DNA67962-1649”.

FIG. 454 shows the amino acid sequence (SEQ ID NO:454) derived from the coding sequence of SEQ ID NO:453 shown in FIG. 453.

FIG. 455 shows a nucleotide sequence (SEQ ID NO:455) of a native sequence PRO19645 cDNA, wherein SEQ ID NO:455 is a clone designated herein as “DNA69555-2867”.

FIG. 456 shows the amino acid sequence (SEQ ID NO:456) derived from the coding sequence of SEQ ID NO:455 shown in FIG. 455.

FIG. 457 shows a nucleotide sequence (SEQ ID NO:457) of a native sequence PRO9782 cDNA, wherein SEQ ID NO:457 is a clone designated herein as “DNA71162-2764”.

FIG. 458 shows the amino acid sequence (SEQ ID NO:458) derived from the coding sequence of SEQ ID NO:457 shown in FIG. 457.

FIG. 459 shows a nucleotide sequence (SEQ ID NO:459) of a native sequence PRO1419 cDNA, wherein SEQ ID NO:459 is a clone designated herein as “DNA71290-1630”.

FIG. 460 shows the amino acid sequence (SEQ ID NO:460) derived from the coding sequence of SEQ ID NO:459 shown in FIG. 459.

FIG. 461 shows a nucleotide sequence (SEQ ID NO:461) of a native sequence PRO1575 cDNA, wherein SEQ ID NO:461 is a clone designated herein as “DNA76401-1683”.

FIG. 462 shows the amino acid sequence (SEQ ID NO:462) derived from the coding sequence of SEQ ID NO:461 shown in FIG. 461.

FIG. 463 shows a nucleotide sequence (SEQ ID NO:463) of a native sequence PRO1567 cDNA, wherein SEQ ID NO:463 is a clone designated herein as “DNA76541-1675”.

FIG. 464 shows the amino acid sequence (SEQ ID NO:464) derived from the coding sequence of SEQ ID NO:463 shown in FIG. 463.

FIG. 465 shows a nucleotide sequence (SEQ ID NO:465) of a native sequence PRO1891 cDNA, wherein SEQ ID NO:465 is a clone designated herein as “DNA76788-2526”.

FIG. 466 shows the amino acid sequence (SEQ ID NO:466) derived from the coding sequence of SEQ ID NO:465 shown in FIG. 465.

FIG. 467 shows a nucleotide sequence (SEQ ID NO:467) of a native sequence PRO1889 cDNA, wherein SEQ ID NO:467 is a clone designated herein as “DNA77623-2524”.

FIG. 468 shows the amino acid sequence (SEQ ID NO:468) derived from the coding sequence of SEQ ID NO:467 shown in FIG. 467.

FIG. 469 shows a nucleotide sequence (SEQ ID NO:469) of a native sequence PRO1785 cDNA, wherein SEQ ID NO:469 is a clone designated herein as “DNA80136-2503”.

FIG. 470 shows the amino acid sequence (SEQ ID NO:470) derived from the coding sequence of SEQ ID NO:469 shown in FIG. 469.

FIG. 471 shows a nucleotide sequence (SEQ ID NO:471) of a native sequence PRO6003 cDNA, wherein SEQ ID NO:471 is a clone designated herein as “DNA83568-2692”.

FIG. 472 shows the amino acid sequence (SEQ ID NO:472) derived from the coding sequence of SEQ ID NO:471 shown in FIG. 471.

FIG. 473 shows a nucleotide sequence (SEQ ID NO:473) of a native sequence PRO4333 cDNA, wherein SEQ ID NO:473 is a clone designated herein as “DNA84210-2576”.

FIG. 474 shows the amino acid sequence (SEQ ID NO:474) derived from the coding sequence of SEQ ID NO:473 shown in FIG. 473.

FIG. 475 shows a nucleotide sequence (SEQ ID NO:475) of a native sequence PRO4356 cDNA, wherein SEQ ID NO:475 is a clone designated herein as “DNA86576-2595”.

FIG. 476 shows the amino acid sequence (SEQ ID NO:476) derived from the coding sequence of SEQ ID NO:475 shown in FIG. 475.

FIG. 477 shows a nucleotide sequence (SEQ ID NO:477) of a native sequence PRO4352 cDNA, wherein SEQ ID NO:477 is a clone designated herein as “DNA87976-2593”.

FIG. 478 shows the amino acid sequence (SEQ ID NO:478) derived from the coding sequence of SEQ ID NO:477 shown in FIG. 477.

FIG. 479 shows a nucleotide sequence (SEQ ID NO:479) of a native sequence PRO4354 cDNA, wherein SEQ ID NO:479 is a clone designated herein as “DNA92256-2596”.

FIG. 480 shows the amino acid sequence (SEQ ID NO:480) derived from the coding sequence of SEQ ID NO:479 shown in FIG. 479.

FIG. 481 shows a nucleotide sequence (SEQ ID NO:481) of a native sequence PRO4369 cDNA, wherein SEQ ID NO:481 is a clone designated herein as “DNA92289-2598”.

FIG. 482 shows the amino acid sequence (SEQ ID NO:482) derived from the coding sequence of SEQ ID NO:481 shown in FIG. 481.

FIG. 483 shows a nucleotide sequence (SEQ ID NO:483) of a native sequence PRO6030 cDNA, wherein SEQ ID NO:483 is a clone designated herein as “DNA96850-2705”.

FIG. 484 shows the amino acid sequence (SEQ ID NO:484) derived from the coding sequence of SEQ ID NO:483 shown in FIG. 483.

FIG. 485 shows a nucleotide sequence (SEQ ID NO:485) of a native sequence PRO4433 cDNA, wherein SEQ ID NO:485 is a clone designated herein as “DNA96855-2629”.

FIG. 486 shows the amino acid sequence (SEQ ID NO:486) derived from the coding sequence of SEQ ID NO:485 shown in FIG. 485.

FIG. 487 shows a nucleotide sequence (SEQ ID NO:487) of a native sequence PRO4424 cDNA, wherein SEQ ID NO:487 is a clone designated herein as “DNA96857-2636”.

FIG. 488 shows the amino acid sequence (SEQ ID NO:488) derived from the coding sequence of SEQ ID NO:487 shown in FIG. 487.

FIG. 489 shows a nucleotide sequence (SEQ ID NO:489) of a native sequence PRO6017 cDNA, wherein SEQ ID NO:489 is a clone designated herein as “DNA96860-2700”.

FIG. 490 shows the amino acid sequence (SEQ ID NO:490) derived from the coding sequence of SEQ ID NO:489 shown in FIG. 489.

FIG. 491 shows a nucleotide sequence (SEQ ID NO:491) of a native sequence PRO19563 cDNA, wherein SEQ ID NO:491 is a clone designated herein as “DNA96861-2844”.

FIG. 492 shows the amino acid sequence (SEQ ID NO:492) derived from the coding sequence of SEQ ID NO:491 shown in FIG. 491.

FIG. 493 shows a nucleotide sequence (SEQ ID NO:493) of a native sequence PRO6015 cDNA, wherein SEQ ID NO:493 is a clone designated herein as “DNA96866-2698”.

FIG. 494 shows the amino acid sequence (SEQ ID NO:494) derived from the coding sequence of SEQ ID NO:493 shown in FIG. 493.

FIG. 495 shows a nucleotide sequence (SEQ ID NO:495) of a native sequence PRO5779 cDNA, wherein SEQ ID NO:495 is a clone designated herein as “DNA96870-2676”.

FIG. 496 shows the amino acid sequence (SEQ ID NO:496) derived from the coding sequence of SEQ ID NO:495 shown in FIG. 495.

FIG. 497 shows a nucleotide sequence (SEQ ID NO:497) of a native sequence PRO5776 cDNA, wherein SEQ ID NO:497 is a clone designated herein as "DNA96872-2674".

FIG. 498 shows the amino acid sequence (SEQ ID NO:498) derived from the coding sequence of SEQ ID NO:497 shown in FIG. 497.

FIG. 499 shows a nucleotide sequence (SEQ ID NO:499) of a native sequence PRO4430 cDNA, wherein SEQ ID NO:499 is a clone designated herein as "DNA96878-2626".

FIG. 500 shows the amino acid sequence (SEQ ID NO:500) derived from the coding sequence of SEQ ID NO:499 shown in FIG. 499.

FIG. 501 shows a nucleotide sequence (SEQ ID NO:501) of a native sequence PRO4421 cDNA, wherein SEQ ID NO:501 is a clone designated herein as "DNA96879-2619".

FIG. 502 shows the amino acid sequence (SEQ ID NO:502) derived from the coding sequence of SEQ ID NO:501 shown in FIG. 501.

FIG. 503 shows a nucleotide sequence (SEQ ID NO:503) of a native sequence PRO4499 cDNA, wherein SEQ ID NO:503 is a clone designated herein as "DNA96889-2641".

FIG. 504 shows the amino acid sequence (SEQ ID NO:504) derived from the coding sequence of SEQ ID NO:503 shown in FIG. 503.

FIG. 505 shows a nucleotide sequence (SEQ ID NO:505) of a native sequence PRO4423 cDNA, wherein SEQ ID NO:505 is a clone designated herein as "DNA96893-2621".

FIG. 506 shows the amino acid sequence (SEQ ID NO:506) derived from the coding sequence of SEQ ID NO:505 shown in FIG. 505.

FIG. 507 shows a nucleotide sequence (SEQ ID NO:507) of a native sequence PRO5998 cDNA, wherein SEQ ID NO:507 is a clone designated herein as "DNA96897-2688".

FIG. 508 shows the amino acid sequence (SEQ ID NO:508) derived from the coding sequence of SEQ ID NO:507 shown in FIG. 507.

FIG. 509 shows a nucleotide sequence (SEQ ID NO:509) of a native sequence PRO4501 cDNA, wherein SEQ ID NO:509 is a clone designated herein as "DNA98564-2643".

FIG. 510 shows the amino acid sequence (SEQ ID NO:510) derived from the coding sequence of SEQ ID NO:509 shown in FIG. 509.

FIG. 511 shows a nucleotide sequence (SEQ ID NO:511) of a native sequence PRO6240 cDNA, wherein SEQ ID NO:511 is a clone designated herein as "DNA107443-2718".

FIG. 512 shows the amino acid sequence (SEQ ID NO:512) derived from the coding sequence of SEQ ID NO:511 shown in FIG. 511.

FIG. 513 shows a nucleotide sequence (SEQ ID NO:513) of a native sequence PRO6245 cDNA, wherein SEQ ID NO:513 is a clone designated herein as "DNA107786-2723".

FIG. 514 shows the amino acid sequence (SEQ ID NO:514) derived from the coding sequence of SEQ ID NO:513 shown in FIG. 513.

FIG. 515 shows a nucleotide sequence (SEQ ID NO:515) of a native sequence PRO6175 cDNA, wherein SEQ ID NO:515 is a clone designated herein as "DNA108682-2712".

FIG. 516 shows the amino acid sequence (SEQ ID NO:516) derived from the coding sequence of SEQ ID NO:515 shown in FIG. 515.

FIG. 517 shows a nucleotide sequence (SEQ ID NO:517) of a native sequence PRO9742 cDNA, wherein SEQ ID NO:517 is a clone designated herein as "DNA108684-2761".

FIG. 518 shows the amino acid sequence (SEQ ID NO:518) derived from the coding sequence of SEQ ID NO:517 shown in FIG. 517.

FIG. 519 shows a nucleotide sequence (SEQ ID NO:519) of a native sequence PRO7179 cDNA, wherein SEQ ID NO:519 is a clone designated herein as "DNA108701-2749".

FIG. 520 shows the amino acid sequence (SEQ ID NO:520) derived from the coding sequence of SEQ ID NO:519 shown in FIG. 519.

FIG. 521 shows a nucleotide sequence (SEQ ID NO:521) of a native sequence PRO6239 cDNA, wherein SEQ ID NO:521 is a clone designated herein as "DNA108720-2717".

FIG. 522 shows the amino acid sequence (SEQ ID NO:522) derived from the coding sequence of SEQ ID NO:521 shown in FIG. 521.

FIG. 523 shows a nucleotide sequence (SEQ ID NO:523) of a native sequence PRO6493 cDNA, wherein SEQ ID NO:523 is a clone designated herein as "DNA108726-2729".

FIG. 524 shows the amino acid sequence (SEQ ID NO:524) derived from the coding sequence of SEQ ID NO:523 shown in FIG. 523.

FIGS. 525A-525B show a nucleotide sequence (SEQ ID NO:525) of a native sequence PRO9741 cDNA, wherein SEQ ID NO:525 is a clone designated herein as "DNA108728-2760".

FIG. 526 shows the amino acid sequence (SEQ ID NO:526) derived from the coding sequence of SEQ ID NO:525 shown in FIGS. 525A-525B.

FIG. 527 shows a nucleotide sequence (SEQ ID NO:527) of a native sequence PRO9822 cDNA, wherein SEQ ID NO:527 is a clone designated herein as "DNA108738-2767".

FIG. 528 shows the amino acid sequence (SEQ ID NO:528) derived from the coding sequence of SEQ ID NO:527 shown in FIG. 527.

FIG. 529 shows a nucleotide sequence (SEQ ID NO:529) of a native sequence PRO6244 cDNA, wherein SEQ ID NO:529 is a clone designated herein as "DNA108743-2722".

FIG. 530 shows the amino acid sequence (SEQ ID NO:530) derived from the coding sequence of SEQ ID NO:529 shown in FIG. 529.

FIG. 531 shows a nucleotide sequence (SEQ ID NO:531) of a native sequence PRO9740 cDNA, wherein SEQ ID NO:531 is a clone designated herein as "DNA108758-2759".

FIG. 532 shows the amino acid sequence (SEQ ID NO:532) derived from the coding sequence of SEQ ID NO:531 shown in FIG. 531.

FIG. 533 shows a nucleotide sequence (SEQ ID NO:533) of a native sequence PRO9739 cDNA, wherein SEQ ID NO:533 is a clone designated herein as "DNA108765-2758".

FIG. 534 shows the amino acid sequence (SEQ ID NO:534) derived from the coding sequence of SEQ ID NO:533 shown in FIG. 533.

FIG. 535 shows a nucleotide sequence (SEQ ID NO:535) of a native sequence PRO7177 cDNA, wherein SEQ ID NO:535 is a clone designated herein as "DNA108783-2747".

FIG. 536 shows the amino acid sequence (SEQ ID NO:536) derived from the coding sequence of SEQ ID NO:535 shown in FIG. 535.

FIG. 537 shows a nucleotide sequence (SEQ ID NO:537) of a native sequence PRO7178 cDNA, wherein SEQ ID NO:537 is a clone designated herein as "DNA108789-2748".

FIG. 538 shows the amino acid sequence (SEQ ID NO:538) derived from the coding sequence of SEQ ID NO:537 shown in FIG. 537.

FIG. 539 shows a nucleotide sequence (SEQ ID NO:539) of a native sequence PRO6246 cDNA, wherein SEQ ID NO:539 is a clone designated herein as "DNA108806-2724".

FIG. 540 shows the amino acid sequence (SEQ ID NO:540) derived from the coding sequence of SEQ ID NO:539 shown in FIG. 539.

FIG. 541 shows a nucleotide sequence (SEQ ID NO:541) of a native sequence PRO6241 cDNA, wherein SEQ ID NO:541 is a clone designated herein as "DNA108936-2719".

FIG. 542 shows the amino acid sequence (SEQ ID NO:542) derived from the coding sequence of SEQ ID NO:541 shown in FIG. 541.

FIG. 543 shows a nucleotide sequence (SEQ ID NO:543) of a native sequence PRO9835 cDNA, wherein SEQ ID NO:543 is a clone designated herein as "DNA119510-2771".

FIG. 544 shows the amino acid sequence (SEQ ID NO:544) derived from the coding sequence of SEQ ID NO:543 shown in FIG. 543.

FIG. 545 shows a nucleotide sequence (SEQ ID NO:545) of a native sequence PRO9857 cDNA, wherein SEQ ID NO:545 is a clone designated herein as "DNA119517-2778".

FIG. 546 shows the amino acid sequence (SEQ ID NO:546) derived from the coding sequence of SEQ ID NO:545 shown in FIG. 545.

FIG. 547 shows a nucleotide sequence (SEQ ID NO:547) of a native sequence PRO7436 cDNA, wherein SEQ ID NO:547 is a clone designated herein as "DNA119535-2756".

FIG. 548 shows the amino acid sequence (SEQ ID NO:548) derived from the coding sequence of SEQ ID NO:547 shown in FIG. 547.

FIG. 549 shows a nucleotide sequence (SEQ ID NO:549) of a native sequence PRO9856 cDNA, wherein SEQ ID NO:549 is a clone designated herein as "DNA119537-2777".

FIG. 550 shows the amino acid sequence (SEQ ID NO:550) derived from the coding sequence of SEQ ID NO:549 shown in FIG. 549.

FIG. 551 shows a nucleotide sequence (SEQ ID NO:551) of a native sequence PRO19605 cDNA, wherein SEQ ID NO:551 is a clone designated herein as "DNA119714-2851".

FIG. 552 shows the amino acid sequence (SEQ ID NO:552) derived from the coding sequence of SEQ ID NO:551 shown in FIG. 551.

FIG. 553 shows a nucleotide sequence (SEQ ID NO:553) of a native sequence PRO9859 cDNA, wherein SEQ ID NO:553 is a clone designated herein as "DNA125170-2780".

FIG. 554 shows the amino acid sequence (SEQ ID NO:554) derived from the coding sequence of SEQ ID NO:553 shown in FIG. 553.

FIG. 555 shows a nucleotide sequence (SEQ ID NO:555) of a native sequence PRO12970 cDNA, wherein SEQ ID NO:555 is a clone designated herein as "DNA129594-2841".

FIG. 556 shows the amino acid sequence (SEQ ID NO:556) derived from the coding sequence of SEQ ID NO:555 shown in FIG. 555.

FIG. 557 shows a nucleotide sequence (SEQ ID NO:557) of a native sequence PRO19626 cDNA, wherein SEQ ID NO:557 is a clone designated herein as "DNA129793-2857".

FIG. 558 shows the amino acid sequence (SEQ ID NO:558) derived from the coding sequence of SEQ ID NO:557 shown in FIG. 557.

FIG. 559 shows a nucleotide sequence (SEQ ID NO:559) of a native sequence PRO9833 cDNA, wherein SEQ ID NO:559 is a clone designated herein as "DNA130809-2769".

FIG. 560 shows the amino acid sequence (SEQ ID NO:560) derived from the coding sequence of SEQ ID NO:559 shown in FIG. 559.

FIG. 561 shows a nucleotide sequence (SEQ ID NO:561) of a native sequence PRO19670 cDNA, wherein SEQ ID NO:561 is a clone designated herein as "DNA131639-2874".

FIG. 562 shows the amino acid sequence (SEQ ID NO:562) derived from the coding sequence of SEQ ID NO:561 shown in FIG. 561.

FIG. 563 shows a nucleotide sequence (SEQ ID NO:563) of a native sequence PRO19624 cDNA, wherein SEQ ID NO:563 is a clone designated herein as "DNA131649-2855".

FIG. 564 shows the amino acid sequence (SEQ ID NO:564) derived from the coding sequence of SEQ ID NO:563 shown in FIG. 563.

FIG. 565 shows a nucleotide sequence (SEQ ID NO:565) of a native sequence PRO19680 cDNA, wherein SEQ ID NO:565 is a clone designated herein as "DNA131652-2876".

FIG. 566 shows the amino acid sequence (SEQ ID NO:566) derived from the coding sequence of SEQ ID NO:565 shown in FIG. 565.

FIG. 567 shows a nucleotide sequence (SEQ ID NO:567) of a native sequence PRO19675 cDNA, wherein SEQ ID NO:567 is a clone designated herein as "DNA131658-2875".

FIG. 568 shows the amino acid sequence (SEQ ID NO:568) derived from the coding sequence of SEQ ID NO:567 shown in FIG. 567.

FIG. 569 shows a nucleotide sequence (SEQ ID NO:569) of a native sequence PRO9834 cDNA, wherein SEQ ID NO:569 is a clone designated herein as "DNA132162-2770".

FIG. 570 shows the amino acid sequence (SEQ ID NO:570) derived from the coding sequence of SEQ ID NO:569 shown in FIG. 569.

FIG. 571 shows a nucleotide sequence (SEQ ID NO:571) of a native sequence PRO9744 cDNA, wherein SEQ ID NO:571 is a clone designated herein as "DNA136110-2763".

FIG. 572 shows the amino acid sequence (SEQ ID NO:572) derived from the coding sequence of SEQ ID NO:571 shown in FIG. 571.

FIG. 573 shows a nucleotide sequence (SEQ ID NO:573) of a native sequence PRO19644 cDNA, wherein SEQ ID NO:573 is a clone designated herein as "DNA139592-2866".

FIG. 574 shows the amino acid sequence (SEQ ID NO:574) derived from the coding sequence of SEQ ID NO:573 shown in FIG. 573.

FIG. 575 shows a nucleotide sequence (SEQ ID NO:575) of a native sequence PRO19625 cDNA, wherein SEQ ID NO:575 is a clone designated herein as "DNA139608-2856".

FIG. 576 shows the amino acid sequence (SEQ ID NO:576) derived from the coding sequence of SEQ ID NO:575 shown in FIG. 575.

FIG. 577 shows a nucleotide sequence (SEQ ID NO:577) of a native sequence PRO19597 cDNA, wherein SEQ ID NO:577 is a clone designated herein as "DNA143292-2848".

FIG. 578 shows the amino acid sequence (SEQ ID NO:578) derived from the coding sequence of SEQ ID NO:577 shown in FIG. 577.

FIG. 579 shows a nucleotide sequence (SEQ ID NO:579) of a native sequence PRO16090 cDNA, wherein SEQ ID NO:579 is a clone designated herein as "DNA144844-2843".

FIG. 580 shows the amino acid sequence (SEQ ID NO:580) derived from the coding sequence of SEQ ID NO:579 shown in FIG. 579.

FIG. 581 shows a nucleotide sequence (SEQ ID NO:581) of a native sequence PRO19576 cDNA, wherein SEQ ID NO:581 is a clone designated herein as "DNA144857-2845".

FIG. 582 shows the amino acid sequence (SEQ ID NO:582) derived from the coding sequence of SEQ ID NO:581 shown in FIG. 581.

FIG. 583 shows a nucleotide sequence (SEQ ID NO:583) of a native sequence PRO19646 cDNA, wherein SEQ ID NO:583 is a clone designated herein as "DNA145841-2868".

FIG. 584 shows the amino acid sequence (SEQ ID NO:584) derived from the coding sequence of SEQ ID NO:583 shown in FIG. 583.

FIG. 585 shows a nucleotide sequence (SEQ ID NO:585) of a native sequence PRO19814 cDNA, wherein SEQ ID NO:585 is a clone designated herein as "DNA148004-2882".

FIG. 586 shows the amino acid sequence (SEQ ID NO:586) derived from the coding sequence of SEQ ID NO:585 shown in FIG. 585.

FIG. 587 shows a nucleotide sequence (SEQ ID NO:587) of a native sequence PRO19669 cDNA, wherein SEQ ID NO:587 is a clone designated herein as "DNA149893-2873".

FIG. 588 shows the amino acid sequence (SEQ ID NO:588) derived from the coding sequence of SEQ ID NO:587 shown in FIG. 587.

FIG. 589 shows a nucleotide sequence (SEQ ID NO:589) of a native sequence PRO19818 cDNA, wherein SEQ ID NO:589 is a clone designated herein as "DNA149930-2884".

FIG. 590 shows the amino acid sequence (SEQ ID NO:590) derived from the coding sequence of SEQ ID NO:589 shown in FIG. 589.

FIG. 591 shows a nucleotide sequence (SEQ ID NO:591) of a native sequence PRO20088 cDNA, wherein SEQ ID NO:591 is a clone designated herein as "DNA150157-2898".

FIG. 592 shows the amino acid sequence (SEQ ID NO:592) derived from the coding sequence of SEQ ID NO:591 shown in FIG. 591.

FIG. 593 shows a nucleotide sequence (SEQ ID NO:593) of a native sequence PRO16089 cDNA, wherein SEQ ID NO:593 is a clone designated herein as "DNA150163-2842".

FIG. 594 shows the amino acid sequence (SEQ ID NO:594) derived from the coding sequence of SEQ ID NO:593 shown in FIG. 593.

FIG. 595 shows a nucleotide sequence (SEQ ID NO:595) of a native sequence PRO20025 cDNA, wherein SEQ ID NO:595 is a clone designated herein as "DNA153579-2894".

FIG. 596 shows the amino acid sequence (SEQ ID NO:596) derived from the coding sequence of SEQ ID NO:595 shown in FIG. 595.

FIG. 597 shows a nucleotide sequence (SEQ ID NO:597) of a native sequence PRO20040 cDNA, wherein SEQ ID NO:597 is a clone designated herein as "DNA164625-2890".

FIG. 598 shows the amino acid sequence (SEQ ID NO:598) derived from the coding sequence of SEQ ID NO:597 shown in FIG. 597.

FIG. 599 shows a nucleotide sequence (SEQ ID NO:599) of a native sequence PRO791 cDNA, wherein SEQ ID NO:599 is a clone designated herein as "DNA57838-1337".

FIG. 600 shows the amino acid sequence (SEQ ID NO:600) derived from the coding sequence of SEQ ID NO:599 shown in FIG. 599.

FIG. 601 shows a nucleotide sequence (SEQ ID NO:601) of a native sequence PRO1131 cDNA, wherein SEQ ID NO:601 is a clone designated herein as "DNA59777-1480".

FIG. 602 shows the amino acid sequence (SEQ ID NO:602) derived from the coding sequence of SEQ ID NO:601 shown in FIG. 601.

FIG. 603 shows a nucleotide sequence (SEQ ID NO:603) of a native sequence PRO1343 cDNA, wherein SEQ ID NO:603 is a clone designated herein as "DNA66675-1587".

FIG. 604 shows the amino acid sequence (SEQ ID NO:604) derived from the coding sequence of SEQ ID NO:603 shown in FIG. 603.

FIG. 605 shows a nucleotide sequence (SEQ ID NO:605) of a native sequence PRO1760 cDNA, wherein SEQ ID NO:605 is a clone designated herein as "DNA76532-1702".

FIG. 606 shows the amino acid sequence (SEQ ID NO:606) derived from the coding sequence of SEQ ID NO:605 shown in FIG. 605.

FIG. 607 shows a nucleotide sequence (SEQ ID NO:607) of a native sequence PRO6029 cDNA, wherein SEQ ID NO:607 is a clone designated herein as "DNA105849-2704".

FIG. 608 shows the amino acid sequence (SEQ ID NO:608) derived from the coding sequence of SEQ ID NO:607 shown in FIG. 607.

FIG. 609 shows a nucleotide sequence (SEQ ID NO:609) of a native sequence PRO1801 cDNA, wherein SEQ ID NO:609 is a clone designated herein as "DNA83500-2506".

FIG. 610 shows the amino acid sequence (SEQ ID NO:610) derived from the coding sequence of SEQ ID NO:609 shown in FIG. 609.

DETAILED DESCRIPTION OF THE PREFERRED EMBODIMENTS

I. Definitions

The terms "PRO polypeptide" and "PRO" as used herein and when immediately followed by a numerical designation refer to various polypeptides, wherein the complete designation (i.e., PRO/number) refers to specific polypeptide sequences as described herein. The terms "PRO/number polypeptide" and "PRO/number" wherein the term "number" is provided as an actual numerical designation as used herein encompass native sequence polypeptides and polypeptide variants (which are further defined herein). The PRO polypeptides described herein may be isolated from a variety of sources, such as from human tissue types or from another source, or prepared by recombinant or synthetic methods. The term "PRO polypeptide" refers to each individual PRO/number polypeptide disclosed herein. All disclosures in this specification which refer to the "PRO polypeptide" refer to each of the polypeptides individually as well as jointly. For example, descriptions of the preparation of, purification of, derivation of, formation of antibodies to or against, administration of, compositions containing, treatment of a disease with, etc., pertain to each polypeptide of the invention individually. The term "PRO polypeptide" also includes variants of the PRO/number polypeptides disclosed herein.

A "native sequence PRO polypeptide" comprises a polypeptide having the same amino acid sequence as the corresponding PRO polypeptide derived from nature. Such native sequence PRO polypeptides can be isolated from nature or can be produced by recombinant or synthetic means. The term "native sequence PRO polypeptide" specifically encompasses naturally-occurring truncated or secreted forms of the specific PRO polypeptide (e.g., an extra cellular domain sequence), naturally-occurring variant forms (e.g., alternatively spliced forms) and naturally-occurring allelic variants of the polypeptide. In various embodiments of the invention, the native sequence PRO polypeptides disclosed herein are mature or full-length native sequence polypeptides comprising the full-length amino acids sequences shown in the accompanying figures. Start and stop codons are shown in bold font and underlined in the figures. However, while the PRO polypeptide disclosed in the accompanying figures are shown to begin with methionine residues designated herein as amino acid position 1 in the figures, it is conceivable and possible that other methionine residues located either upstream or downstream from the amino acid position 1 in the figures may be employed as the starting amino acid residue for the PRO polypeptides.

The PRO polypeptide "extracellular domain" or "ECD" refers to a form of the PRO polypeptide which is essentially free of the transmembrane and cytoplasmic domains. Ordinarily, a PRO polypeptide ECD will have less than 1% of such transmembrane and/or cytoplasmic domains and preferably, will have less than 0.5% of such domains. It will be understood that any transmembrane domains identified for the PRO polypeptides of the present invention are identified pursuant to criteria routinely employed in the art for identifying that type of hydrophobic domain. The exact boundaries of a transmembrane domain may vary but most likely by no more than about 5 amino acids at either end of the domain as initially identified herein. Optionally, therefore, an extracellular domain of a PRO polypeptide may contain from about 5 or fewer amino acids on either side of the transmembrane domain/extracellular domain boundary as identified in the Examples or specification and such polypeptides, with or without the associated signal peptide, and nucleic acid encoding them, are comtemplated by the present invention.

The approximate location of the "signal peptides" of the various PRO polypeptides disclosed herein are shown in the present specification and/or the accompanying figures. It is noted, however, that the C-terminal boundary of a signal peptide may vary, but most likely by no more than about 5 amino acids on either side of the signal peptide C-terminal boundary as initially identified herein, wherein the C-terminal boundary of the signal peptide may be identified pursuant to criteria routinely employed in the art for identifying that type of amino acid sequence element (e.g., Nielsen et al., *Prot. Eng.* 10:1-6(1997) and von Heinje et al., *Nucl. Acids. Res.* 14:4683-4690 (1986)). Moreover, it is also recognized that, in some cases, cleavage of a signal sequence from a secreted polypeptide is not entirely uniform, resulting in more than one secreted species. These mature polypeptides, where the signal peptide is cleaved within no more than about 5 amino acids on either side of the C-terminal boundary of the signal peptide as identified herein, and the polynucleotides encoding them, are contemplated by the present invention.

"PRO polypeptide variant" means an active PRO polypeptide as defined above or below having at least about 80% amino acid sequence identity with a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Such PRO polypeptide variants include, for instance, PRO polypeptides wherein one or more amino acid residues are added, or deleted, at the N- or C-terminus of the full-length native amino acid sequence. Ordinarily, a PRO polypeptide variant will have at least about 80% amino acid sequence identity, alternatively at least about 81% amino acid sequence identity, alternatively at least about 82% amino acid sequence identity, alternatively at least about 83% amino acid sequence identity, alternatively at least about 84% amino acid sequence identity, alternatively at least about 85% amino acid sequence identity, alternatively at least about 86% amino acid sequence identity, alternatively at least about 87% amino acid sequence identity, alternatively at least about 88% amino acid sequence identity, alternatively at least about 89% amino acid sequence identity, alternatively at least about 90% amino acid sequence identity, alternatively at least about 91% amino acid sequence identity, alternatively at least about 92% amino acid sequence identity, alternatively at least about 93% amino acid sequence identity, alternatively at least about 94% amino acid sequence identity, alternatively at least about 95% amino acid sequence identity, alternatively at least about 96% amino acid sequence identity, alternatively at least about 97% amino acid sequence identity, alternatively at least about 98% amino acid sequence identity and alternatively at least about 99% amino acid sequence identity to a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other specifically defined fragment of a full-length PRO polypeptide sequence as disclosed herein. Ordinarily, PRO variant polypeptides are at least about 10 amino acids in length, alternatively at least about 20 amino acids in length, alternatively at least about 30 amino acids in length, alternatively at least about 40 amino acids in length, alternatively at least about 50 amino acids in length, alternatively at least about 60 amino acids in length, alternatively at least about 70 amino acids in length, alternatively at least about 80 amino acids in length, alternatively at least about 90 amino acids in length, alternatively at least about 100 amino acids in length, alternatively at least about 150 amino acids in length, alternatively at least about 200 amino acids in length, alternatively at least about 300 amino acids in length, or more.

"Percent (%) amino acid sequence identity" with respect to the PRO polypeptide sequences identified herein is defined as the percentage of amino acid residues in a candidate sequence that are identical with the amino acid residues in the specific PRO polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. For purposes herein, however, % amino acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.OD. All sequence comparison parameters are set by the ALIGN-2 program and do not vary.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. As examples of % amino acid sequence identity calculations using this method, Tables 2 and 3 demonstrate how to calculate the % amino acid sequence identity of the amino acid sequence designated “Comparison Protein” to the amino acid sequence designated “PRO”, wherein “PRO” represents the amino acid sequence of a hypothetical PRO polypeptide of interest, “Comparison Protein” represents the amino acid sequence of a polypeptide against which the “PRO” polypeptide of interest is being compared, and “X, “Y” and “Z” each represent different hypothetical amino acid residues.

Unless specifically stated otherwise, all % amino acid sequence identity values used herein are obtained as described in the immediately preceding paragraph using the ALIGN-2 computer program. However, % amino acid sequence identity values may also be obtained as described below by using the WU-BLAST-2 computer program (Altschul et al., *Methods in Enzymology* 266:460-480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % amino acid sequence identity value is determined by dividing (a) the number of matching identical amino acid residues between the amino acid sequence of the PRO polypeptide of interest having a sequence derived from the native PRO polypeptide and the comparison amino acid sequence of interest (i.e., the sequence against which the PRO polypeptide of interest is being compared which may be a PRO variant polypeptide) as determined by WU-BLAST-2 by (b) the total number of amino acid residues of the PRO polypeptide of interest. For example, in the statement “a polypeptide comprising an the amino acid sequence A which has or having at least 80% amino acid sequence identity to the amino acid sequence B”, the amino acid sequence A is the comparison amino acid sequence of interest and the amino acid sequence B is the amino acid sequence of the PRO polypeptide of interest.

Percent amino acid sequence identity may also be determined using the sequence comparison program NCBI-BLAST2 (Altschul et al., *Nucleic Acids Res.* 25:3389-3402 (1997)). The NCBI-BLAST2 sequence comparison program may be obtained from the National Institute of Health, Bethesda, Md. NCBI-BLAS2 uses several search parameters, wherein all of those search parameters are set to default values including, for example, unmask=yes, strand=all, expected occurrences=10, minimum low complexity length=15/5, multi-pass e-value=0.01, constant for multi-pass=25, dropoff for final gapped alignment=25 and scoring matrix=BLOSUM62.

In situations where NCBI-BLAST2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program NCBI-BLAST2 in that program’s alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A.

“PRO variant polynucleotide” or “PRO variant nucleic acid sequence” means a nucleic acid molecule which encodes an active PRO polypeptide as defined below and which has at least about 80% nucleic acid sequence identity with a nucleotide acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Ordinarily, a PRO variant polynucleotide will have at least about 80% nucleic acid sequence identity, alternatively at least about 81% nucleic acid sequence identity, alternatively at least about 82% nucleic acid sequence identity, alternatively at least about 83% nucleic acid sequence identity, alternatively at least about 84% nucleic acid sequence identity, alternatively at least about 85% nucleic acid sequence identity, alternatively at least about 86% nucleic acid sequence identity, alternatively at least about 87% nucleic acid sequence identity, alternatively at least about 88% nucleic acid sequence identity, alternatively at least about 89% nucleic acid sequence identity, alternatively at least about 90% nucleic acid sequence identity, alternatively at least about 91% nucleic acid sequence identity, alternatively at least about 92% nucleic acid sequence identity, alternatively at least about 93% nucleic acid sequence identity, alternatively at least about 94% nucleic acid sequence identity, alternatively at least about 95% nucleic acid sequence identity, alternatively at least about 96% nucleic acid sequence identity, alternatively at least about 97% nucleic acid sequence identity, alternatively at least about 98% nucleic acid sequence identity and alternatively at least about 99% nucleic acid sequence identity with a nucleic acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal sequence, as disclosed herein or any other fragment of a full-length PRO polypeptide sequence as disclosed herein. Variants do not encompass the native nucleotide sequence.

Ordinarily, PRO variant polynucleotides are at least about 30 nucleotides in length, alternatively at least about 60 nucleotides in length, alternatively at least about 90 nucleotides in length, alternatively at least about 120 nucleotides in length, alternatively at least about 150 nucleotides in length, alternatively at least about 180 nucleotides in length, alternatively at least about 210 nucleotides in length, alternatively at least about 240 nucleotides in length, alternatively at least about 270 nucleotides in length, alternatively at least about 300 nucleotides in length, alternatively at least about 450 nucleotides in length, alternatively at least about 600 nucleotides in length, alternatively at least about 900 nucleotides in length, or more.

“Percent (%) nucleic acid sequence identity” with respect to PRO-encoding nucleic acid sequences identified herein is defined as the percentage of nucleotides in a candidate sequence that are identical with the nucleotides in the PRO nucleic acid sequence of interest, after aligning the sequences and introducing gaps, if necessary, to achieve the maximum percent sequence identity. Alignment for purposes of determining percent nucleic acid sequence identity can be achieved in various ways that are within the skill in the art, for instance, using publicly available computer software such as BLAST, BLAST-2, ALIGN or Megalign (DNASTAR) software. For purposes herein, however, % nucleic acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for nucleic acid sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program ALIGN-2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C. As examples of % nucleic acid sequence identity calculations, Tables 4 and 5, demonstrate how to calculate the % nucleic acid sequence identity of the nucleic acid sequence designated "Comparison DNA" to the nucleic acid sequence designated "PRO-DNA", wherein "PRO-DNA" represents a hypothetical PRO-encoding nucleic acid sequence of interest, "Comparison DNA" represents the nucleotide sequence of a nucleic acid molecule against which the "PRO-DNA" nucleic acid molecule of interest is being compared, and "N", "L" and "V" each represent different hypothetical nucleotides.

Unless specifically stated otherwise, all % nucleic acid sequence identity values used herein are obtained as described in the immediately preceding paragraph using the ALIGN-2 computer program. However, % nucleic acid sequence identity values may also be obtained as described below by using the WU-BLAST-2 computer program (Altschul et al., *Methods in Enzymology* 266:460-480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % nucleic acid sequence identity value is determined by dividing (a) the number of matching identical nucleotides between the nucleic acid sequence of the PRO polypeptide-encoding nucleic acid molecule of interest having a sequence derived from the native sequence PRO polypeptide-encoding nucleic acid and the comparison nucleic acid molecule of interest (i.e., the sequence against which the PRO polypeptide-encoding nucleic acid molecule of interest is being compared which may be a variant PRO polynucleotide) as determined by WU-BLAST-2 by (b) the total number of nucleotides of the PRO polypeptide-encoding nucleic acid molecule of interest. For example, in the statement "an isolated nucleic acid molecule comprising a nucleic acid sequence A which has or having at least 80% nucleic acid sequence identity to the nucleic acid sequence B", the nucleic acid sequence A is the comparison nucleic acid molecule of interest and the nucleic acid sequence B is the nucleic acid sequence of the PRO polypeptide-encoding nucleic acid molecule of interest.

Percent nucleic acid sequence identity may also be determined using the sequence comparison program NCBI-BLAST2 (Altschul et al., Nucleic Acids Res. 25:3389-3402 (1997)). The NCBI-BLAST2 sequence comparison program may be obtained from the National Institute of Health, Bethesda, Md. NCBI-BLAST2 uses several search parameters, wherein all of those search parameters are set to default values including, for example, unmask=yes, strand=all, expected occurrences=10, minimum low complexity length=15/5, multi-pass e-value=0.01, constant for multi-pass=25, dropoff for final gapped alignment=25 and scoring matrix=BLOSUM62.

In situations where NCBI-BLAST2 is employed for sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program NCBI-BLAST2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C.

In other embodiments, PRO variant polynucleotides are nucleic acid molecules that encode an active PRO polypeptide and which are capable of hybridizing, preferably under stringent hybridization and wash conditions, to nucleotide sequences encoding a full-length PRO polypeptide as disclosed herein. PRO variant polypeptides may be those that are encoded by a PRO variant polynucleotide.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. In preferred embodiments, the polypeptide will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Isolated polypeptide includes polypeptide in situ within recombinant cells, since at least one component of the PRO polypeptide natural environment will not be present. Ordinarily, however, isolated polypeptide will be prepared by at least one purification step.

An "isolated" PRO polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal location different from that of natural cells.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The term "antibody" is used in the broadest sense and specifically covers, for example, single anti-PRO monoclonal antibodies (including agonist, antagonist, and neutralizing antibodies), anti-PRO antibody compositions with polyepitopic specificity, single chain anti-PRO antibodies, and fragments of anti-PRO antibodies (see below). The term "monoclonal antibody" as used herein refers to an antibody obtained from a population of substantially homogeneous antibodies, i.e., the individual antibodies comprising the population are identical except for possible naturally-occurring mutations that may be present in minor amounts.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to reanneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., *Current Protocols in Molecular Biology,* Wiley Interscience Publishers, (1995).

"Stringent conditions" or "high stringency conditions", as defined herein, may be identified by those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C.

"Moderately stringent conditions" may be identified as described by Sambrook et al., *Molecular Cloning: A Laboratory Manual,* New York: Cold Spring Harbor Press, 1989, and include the use of washing solution and hybridization conditions (e.g., temperature, ionic strength and % SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

The term "epitope tagged" when used herein refers to a chimeric polypeptide comprising a PRO polypeptide fused to a "tag polypeptide". The tag polypeptide has enough residues to provide an epitope against which an antibody can be made, yet is short enough such that it does not interfere with activity of the polypeptide to which it is fused. The tag polypeptide preferably also is fairly unique so that the antibody does not substantially cross-react with other epitopes. Suitable tag polypeptides generally have at least six amino acid residues and usually between about 8 and 50 amino acid residues (preferably, between about 10 and 20 amino acid residues).

As used herein, the term "immunoadhesin" designates antibody-like molecules which combine the binding specificity of a heterologous protein (an "adhesin") with the effector functions of immunoglobulin constant domains. Structurally, the immunoadhesins comprise a fusion of an amino acid sequence with the desired binding specificity which is other than the antigen recognition and binding site of an antibody (i.e., is "heterologous"), and an immunoglobulin constant domain sequence. The adhesin part of an immunoadhesin molecule typically is a contiguous amino acid sequence comprising at least the binding site of a receptor or a ligand. The immunoglobulin constant domain sequence in the immunoadhesin may be obtained from any immunoglobulin, such as IgG-1, IgG-2, IgG-3, or IgG-4 subtypes, IgA (including IgA-1 and IgA-2), IgE, IgD or IgM.

"Active" or "activity" for the purposes herein refers to form(s) of a PRO polypeptide which retain a biological and/or an immunological activity of native or naturally-occurring PRO, wherein "biological" activity refers to a biological function (either inhibitory or stimulatory) caused by a native or naturally-occurring PRO other than the ability to induce the production of an antibody against an antigenic epitope possessed by a native or naturally-occurring PRO and an "immunological" activity refers to the ability to induce the production of an antibody against an antigenic epitope possessed by a native or naturally-occurring PRO.

The term "antagonist" is used in the broadest sense, and includes any molecule that partially or fully blocks, inhibits, or neutralizes a biological activity of a native PRO polypeptide disclosed herein. In a similar manner, the term "agonist" is used in the broadest sense and includes any molecule that mimics a biological activity of a native PRO polypeptide disclosed herein. Suitable agonist or antagonist molecules specifically include agonist or antagonist antibodies or antibody fragments, fragments or amino acid sequence variants of native PRO polypeptides, peptides, antisense oligonucleotides, small organic molecules, etc. Methods for identifying agonists or antagonists of a PRO polypeptide may comprise contacting a PRO polypeptide with a candidate agonist or antagonist molecule and measuring a detectable change in one or more biological activities normally associated with the PRO polypeptide.

"Treatment" refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented.

"Chronic" administration refers to administration of the agent(s) in a continuous mode as opposed to an acute mode, so as to maintain the initial therapeutic effect (activity) for an extended period of time. "Intermittent" administration is treatment that is not consecutively done without interruption, but rather is cyclic in nature.

"Mammal" for purposes of treatment refers to any animal classified as a mammal, including humans, domestic and farm animals, and zoo, sports, or pet animals, such as dogs, cats, cattle, horses, sheep, pigs, goats, rabbits, etc. Preferably, the mammal is human.

Administration "in combination with" one or more further therapeutic agents includes simultaneous (concurrent) and consecutive administration in any order.

"Carriers" as used herein include pharmaceutically acceptable carriers, excipients, or stabilizers which are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™.

"Antibody fragments" comprise a portion of an intact antibody, preferably the antigen binding or variable region of the intact antibody. Examples of antibody fragments include Fab, Fab', $F(ab)_2$, and Fv fragments; diabodies; linear antibodies (Zapata et al., *Protein Eng.* 8(10):1057-1062 [1995]); single-chain antibody molecules; and multispecific antibodies formed from antibody fragments.

Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an $F(ab)_2$ fragment that has two antigen-combining sites and is still capable of cross-linking antigen.

"Fv" is the minimum antibody fragment which contains a complete antigen-recognition and -binding site. This region consists of a dimer of one heavy- and one light-chain variable domain in tight, non-covalent association. It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment also contains the constant domain of the light chain and the first constant domain (CH1) of the heavy chain. Fab fragments differ from Fab' fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. $F(ab')_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their constant domains.

Depending on the amino acid sequence of the constant domain of their heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA, and IgA2.

"Single-chain Fv" or "sFv" antibody fragments comprise the $V_H$ and $V_L$ domains of antibody, wherein these domains are present in a single polypeptide chain. Preferably, the Fv polypeptide further comprises a polypeptide linker between the $V_H$ and $V_L$ domains which enables the sFv to form the desired structure for antigen binding. For a review of sFv, see Pluckthun in *The Pharmacology of Monoclonal Antibodies*, vol. 113, Rosenburg and Moore eds., Springer-Verlag, New York, pp. 269-315 (1994).

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., *Proc. Natl. Acad. Sci. USA,* 90:6444-6448 (1993).

An "isolated" antibody is one which has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

An antibody that "specifically binds to" or is "specific for" a particular polypeptide or an epitope on a particular polypeptide is one that binds to that particular polypeptide or epitope on a particular polypeptide without substantially binding to any other polypeptide or polypeptide epitope.

The word "label" when used herein refers to a detectable compound or composition which is conjugated directly or indirectly to the antibody so as to generate a "labeled" antibody. The label may be detectable by itself (e.g. radioisotope labels or fluorescent labels) or, in the case of an enzymatic label, may catalyze chemical alteration of a substrate compound or composition which is detectable.

By "solid phase" is meant a non-aqueous matrix to which the antibody of the present invention can adhere. Examples of solid phases encompassed herein include those formed partially or entirely of glass (e.g., controlled pore glass), polysaccharides (e.g., agarose), polyacrylamides, polystyrene, polyvinyl alcohol and silicones. In certain embodiments, depending on the context, the solid phase can comprise the well of an assay plate; in others it is a purification column (e.g., an affinity chromatography column). This term also includes a discontinuous solid phase of discrete particles, such as those described in U.S. Pat, No. 4,275,149.

A "liposome" is a small vesicle composed of various types of lipids, phospholipids and/or surfactant which is useful for delivery of a drug (such as a PRO polypeptide or antibody thereto) to a mammal. The components of the liposome are commonly arranged in a bilayer formation, similar to the lipid arrangement of biological membranes.

A "small molecule" is defined herein to have a molecular weight below about 500 Daltons.

An "effective amount" of a polypeptide disclosed herein or an agonist or antagonist thereof is an amount sufficient to carry out a specifically stated purpose. An "effective amount" may be determined empirically and in a routine manner, in relation to the stated purpose.

Table 1

```
/*
 *
 * C-C increased from 12 to 15
 * Z is average of EQ
 * B is average of ND
 * match with stop is _M; stop-stop = 0; J (joker) match = 0
 */
#define  _M      -8        /* value of a match with a stop */

int      _day[26][26] = {
/*     A B C D E F G H I J K L M N O P Q R S T U V W X Y Z */
/* A */   { 2, 0,-2, 0, 0,-4, 1,-1,-1, 0,-1,-2,-1, 0,_M, 1, 0,-2, 1, 1, 0, 0,-6, 0,-3, 0},
/* B */   { 0, 3,-4, 3, 2,-5, 0, 1,-2, 0, 0,-3,-2, 2,_M,-1, 1, 0, 0, 0, 0,-2,-5, 0,-3, 1},
/* C */   {-2,-4,15,-5,-5,-4,-3,-3,-2, 0,-5,-6,-5,-4,_M,-3,-5,-4, 0,-2, 0,-2,-8, 0, 0,-5},
/* D */   { 0, 3,-5, 4, 3,-6, 1, 1,-2, 0, 0,-4,-3, 2,_M,-1, 2,-1, 0, 0, 0,-2,-7, 0,-4, 2},
/* E */   { 0, 2,-5, 3, 4,-5, 0, 1,-2, 0, 0,-3,-2, 1,_M,-1, 2,-1, 0, 0, 0,-2,-7, 0,-4, 3},
/* F */   {-4,-5,-4,-6,-5, 9,-5,-2, 1, 0,-5, 2, 0,-4,_M,-5,-5,-4,-3,-3, 0,-1, 0, 0, 7,-5},
/* G */   { 1, 0,-3, 1, 0,-5, 5,-2,-3, 0,-2,-4,-3, 0,_M,-1,-1,-3, 1, 0, 0,-1,-7, 0,-5, 0},
/* H */   {-1, 1,-3, 1, 1,-2,-2, 6,-2, 0, 0,-2,-2, 2,_M, 0, 3, 2,-1,-1, 0,-2,-3, 0, 0, 2},
/* I */   {-1,-2,-2,-2,-2, 1,-3,-2, 5, 0,-2, 2, 2,-2,_M,-2,-2,-2,-1, 0, 0, 4,-5, 0,-1,-2},
/* J */   { 0, 0, 0, 0, 0, 0, 0, 0, 0, 0, 0, 0, 0, 0,_M, 0, 0, 0, 0, 0, 0, 0, 0, 0, 0, 0},
/* K */   {-1, 0,-5, 0, 0,-5,-2, 0,-2, 0, 5,-3, 0, 1,_M,-1, 1, 3, 0, 0, 0,-2,-3, 0,-4, 0},
/* L */   {-2,-3,-6,-4,-3, 2,-4,-2, 2, 0,-3, 6, 4,-3,_M,-3,-2,-3,-3,-1, 0, 2,-2, 0,-1,-2},
/* M */   {-1,-2,-5,-3,-2, 0,-3,-2, 2, 0, 0, 4, 6,-2,_M,-2,-1, 0,-2,-1, 0, 2,-4, 0,-2,-1},
/* N */   { 0, 2,-4, 2, 1,-4, 0, 2,-2, 0, 1,-3,-2, 2,_M,-1, 1, 0, 1, 0, 0,-2,-4, 0,-2, 1},
/* O */   {_M,_M,_M,_M,_M,_M,_M,_M,_M,_M,_M,_M,_M,_M, 0,_M,_M,_M,_M,_M,_M,_M,_M,_M,_M,_M},
/* P */   { 1,-1,-3,-1,-1,-5,-1, 0,-2, 0,-1,-3,-2,-1,_M, 6, 0, 0, 1, 0, 0,-1,-6, 0,-5, 0},
/* Q */   { 0, 1,-5, 2, 2,-5,-1, 3,-2, 0, 1,-2,-1, 1,_M, 0, 4, 1,-1,-1, 0,-2,-5, 0,-4, 3},
/* R */   {-2, 0,-4,-1,-1,-4,-3, 2,-2, 0, 3,-3, 0, 0,_M, 0, 1, 6, 0,-1, 0,-2, 2, 0,-4, 0},
/* S */   { 1, 0, 0, 0, 0,-3, 1,-1,-1, 0, 0,-3,-2, 1,_M, 1,-1, 0, 2, 1, 0,-1,-2, 0,-3, 0},
/* T */   { 1, 0,-2, 0, 0,-3, 0,-1, 0, 0, 0,-1,-1, 0,_M, 0,-1,-1, 1, 3, 0, 0,-5, 0,-3, 0},
/* U */   { 0, 0, 0, 0, 0, 0, 0, 0, 0, 0, 0, 0, 0, 0,_M, 0, 0, 0, 0, 0, 0, 0, 0, 0, 0, 0},
/* V */   { 0,-2,-2,-2,-2,-1,-1,-2, 4, 0,-2, 2, 2,-2,_M,-1,-2,-2,-1, 0, 0, 4,-6, 0,-2,-2},
/* W */   {-6,-5,-8,-7,-7, 0,-7,-3,-5, 0,-3,-2,-4,-4,_M,-6,-5, 2,-2,-5, 0,-6,17, 0, 0,-6},
/* X */   { 0, 0, 0, 0, 0, 0, 0, 0, 0, 0, 0, 0, 0, 0,_M, 0, 0, 0, 0, 0, 0, 0, 0, 0, 0, 0},
/* Y */   {-3,-3, 0,-4,-4, 7,-5, 0,-1, 0,-4,-1,-2,-2,_M,-5,-4,-4,-3,-3, 0,-2, 0, 0,10,-4},
/* Z */   { 0, 1,-5, 2, 3,-5, 0, 2,-2, 0, 0,-2,-1, 1,_M, 0, 3, 0, 0, 0, 0,-2,-6, 0,-4, 4}
};
```

Table 1 (cont')

```
/*
 */
#include <stdio.h>
#include <ctype.h>

#define  MAXJMP    16     /* max jumps in a diag */
#define  MAXGAP    24     /* don't continue to penalize gaps larger than this */
#define  JMPS      1024   /* max jmps in an path */
#define  MX        4      /* save if there's at least MX-1 bases since last jmp */

#define  DMAT      3      /* value of matching bases */
#define  DMIS      0      /* penalty for mismatched bases */
#define  DINS0     8      /* penalty for a gap */
#define  DINS1     1      /* penalty per base */
#define  PINS0     8      /* penalty for a gap */
#define  PINS1     4      /* penalty per residue */

struct jmp {
        short             n[MAXJMP];     /* size of jmp (neg for dely) */
        unsigned short    x[MAXJMP];     /* base no. of jmp in seq x */
};                                       /* limits seq to 2^16 -1 */

struct diag {
        int               score;         /* score at last jmp */
        long              offset;        /* offset of prev block */
        short             ijmp;          /* current jmp index */
        struct jmp        jp;            /* list of jmps */
};

struct path {
        int      spc;                /* number of leading spaces */
        short    n[JMPS]; /* size of jmp (gap) */
        int      x[JMPS]; /* loc of jmp (last elem before gap) */
};

char            *ofile;                  /* output file name */
char            *namex[2];               /* seq names: getseqs() */
char            *prog;                   /* prog name for err msgs */
char            *seqx[2];                /* seqs: getseqs() */
int             dmax;                    /* best diag: nw() */
int             dmax0;                   /* final diag */
int             dna;                     /* set if dna: main() */
int             endgaps;                 /* set if penalizing end gaps */
int             gapx, gapy;              /* total gaps in seqs */
int             len0, len1;              /* seq lens */
int             ngapx, ngapy;            /* total size of gaps */
int             smax;                    /* max score: nw() */
int             *xbm;                    /* bitmap for matching */
long            offset;                  /* current offset in jmp file */
struct  diag    *dx;                     /* holds diagonals */
struct  path    pp[2];                   /* holds path for seqs */

char            *calloc(), *malloc(), *index(), *strcpy();
char            *getseq(), *g_calloc();
```

Table 1 (cont')

```
/* Needleman-Wunsch alignment program
 *
 * usage: progs file1 file2
 *   where file1 and file2 are two dna or two protein sequences.
 *   The sequences can be in upper- or lower-case an may contain ambiguity
 *   Any lines beginning with ';', '>' or '<' are ignored
 *   Max file length is 65535 (limited by unsigned short x in the jmp struct)
 *   A sequence with 1/3 or more of its elements ACGTU is assumed to be DNA
 *   Output is in the file "align.out"
 *
 * The program may create a tmp file in /tmp to hold info about traceback.
 * Original version developed under BSD 4.3 on a vax 8650
 */
#include "nw.h"
#include "day.h"

static  _dbval[26] = {
        1,14,2,13,0,0,4,11,0,0,12,0,3,15,0,0,0,5,6,8,8,7,9,0,10,0
};

static  _pbval[26] = {
        1, 2|(1<<('D'-'A'))|(1<<('N'-'A')), 4, 8, 16, 32, 64,
        128, 256, 0xFFFFFFF, 1<<10, 1<<11, 1<<12, 1<<13, 1<<14,
        1<<15, 1<<16, 1<<17, 1<<18, 1<<19, 1<<20, 1<<21, 1<<22,
        1<<23, 1<<24, 1<<25|(1<<('E'-'A'))|(1<<('Q'-'A'))
};

main(ac, av)                                                              main
        int     ac;
        char    *av[];
{
        prog = av[0];
        if (ac != 3) {
                fprintf(stderr,"usage: %s file1 file2\n", prog);
                fprintf(stderr,"where file1 and file2 are two dna or two protein sequences.\n");
                fprintf(stderr,"The sequences can be in upper- or lower-case\n");
                fprintf(stderr,"Any lines beginning with ';' or '<' are ignored\n");
                fprintf(stderr,"Output is in the file \"align.out\"\n");
                exit(1);
        }
        namex[0] = av[1];
        namex[1] = av[2];
        seqx[0] = getseq(namex[0], &len0);
        seqx[1] = getseq(namex[1], &len1);
        xbm = (dna)? _dbval : _pbval;

        endgaps = 0;                    /* 1 to penalize endgaps */
        ofile = "align.out";            /* output file */

        nw();           /* fill in the matrix, get the possible jmps */
        readjmps();     /* get the actual jmps */
        print();        /* print stats, alignment */

        cleanup(0);     /* unlink any tmp files */
}
```

Table 1 (cont')

```
/* do the alignment, return best score: main()
 * dna: values in Fitch and Smith, PNAS, 80, 1382-1386, 1983
 * pro: PAM 250 values
 * When scores are equal, we prefer mismatches to any gap, prefer
 * a new gap to extending an ongoing gap, and prefer a gap in seqx
 * to a gap in seq y.
 */
nw()                                                                                                    nw
{
        char            *px, *py;         /* seqs and ptrs */
        int             *ndely, *dely;    /* keep track of dely */
        int             ndelx, delx;      /* keep track of delx */
        int             *tmp;             /* for swapping row0, row1 */
        int             mis;              /* score for each type */
        int             ins0, ins1;       /* insertion penalties */
        register        id;               /* diagonal index */
        register        ij;               /* jmp index */
        register        *col0, *col1;     /* score for curr, last row */
        register        xx, yy;           /* index into seqs */

        dx = (struct diag *)g_calloc("to get diags", len0+len1+1, sizeof(struct diag));

        ndely = (int *)g_calloc("to get ndely", len1+1, sizeof(int));
        dely = (int *)g_calloc("to get dely", len1+1, sizeof(int));
        col0 = (int *)g_calloc("to get col0", len1+1, sizeof(int));
        col1 = (int *)g_calloc("to get col1", len1+1, sizeof(int));
        ins0 = (dna)? DINS0 : PINS0;
        ins1 = (dna)? DINS1 : PINS1;

        smax = -10000;
        if (endgaps) {
                for (col0[0] = dely[0] = -ins0, yy = 1; yy <= len1; yy++) {
                        col0[yy] = dely[yy] = col0[yy-1] - ins1;
                        ndely[yy] = yy;
                }
                col0[0] = 0;            /* Waterman Bull Math Biol 84 */
        }
        else
                for (yy = 1; yy <= len1; yy++)
                        dely[yy] = -ins0;

        /* fill in match matrix
         */
        for (px = seqx[0], xx = 1; xx <= len0; px++, xx++) {
                /* initialize first entry in col
                 */
                if (endgaps) {
                        if (xx == 1)
                                col1[0] = delx = -(ins0+ins1);
                        else
                                col1[0] = delx = col0[0] - ins1;
                        ndelx = xx;
                }
                else {
                        col1[0] = 0;
                        delx = -ins0;
                        ndelx = 0;
                }
```

Table 1 (cont')

...nw

```
for (py = seqx[1], yy = 1; yy <= len1; py++, yy++) {
        mis = col0[yy-1];
        if (dna)
                mis += (xbm[*px-'A']&xbm[*py-'A'])? DMAT : DMIS;
        else
                mis += _day[*px-'A'][*py-'A'];

        /* update penalty for del in x seq;
         * favor new del over ongong del
         * ignore MAXGAP if weighting endgaps
         */
        if (endgaps || ndely[yy] < MAXGAP) {
                if (col0[yy] - ins0 >= dely[yy]) {
                        dely[yy] = col0[yy] - (ins0+ins1);
                        ndely[yy] = 1;
                } else {
                        dely[yy] -= ins1;
                        ndely[yy]++;
                }
        } else {
                if (col0[yy] - (ins0+ins1) >= dely[yy]) {
                        dely[yy] = col0[yy] - (ins0+ins1);
                        ndely[yy] = 1;
                } else
                        ndely[yy]++;
        }

        /* update penalty for del in y seq;
         * favor new del over ongong del
         */
        if (endgaps || ndelx < MAXGAP) {
                if (col1[yy-1] - ins0 >= delx) {
                        delx = col1[yy-1] - (ins0+ins1);
                        ndelx = 1;
                } else {
                        delx -= ins1;
                        ndelx++;
                }
        } else {
                if (col1[yy-1] - (ins0+ins1) >= delx) {
                        delx = col1[yy-1] - (ins0+ins1);
                        ndelx = 1;
                } else
                        ndelx++;
        }

        /* pick the maximum score; we're favoring
         * mis over any del and delx over dely
         */
```

Table 1 (cont')

...nw

```
id = xx - yy + len1 - 1;
if (mis >= delx && mis >= dely[yy])
	col1[yy] = mis;
else if (delx >= dely[yy]) {
	col1[yy] = delx;
	ij = dx[id].ijmp;
	if (dx[id].jp.n[0] && (!dna || (ndelx >= MAXJMP
	&& xx > dx[id].jp.x[ij]+MX) || mis > dx[id].score+DINS0)) {
		dx[id].ijmp++;
		if (++ij >= MAXJMP) {
			writejmps(id);
			ij = dx[id].ijmp = 0;
			dx[id].offset = offset;
			offset += sizeof(struct jmp) + sizeof(offset);
		}
	}
	dx[id].jp.n[ij] = ndelx;
	dx[id].jp.x[ij] = xx;
	dx[id].score = delx;
}
else {
	col1[yy] = dely[yy];
	ij = dx[id].ijmp;
if (dx[id].jp.n[0] && (!dna || (ndely[yy] >= MAXJMP
	&& xx > dx[id].jp.x[ij]+MX) || mis > dx[id].score+DINS0)) {
		dx[id].ijmp++;
		if (++ij >= MAXJMP) {
			writejmps(id);
			ij = dx[id].ijmp = 0;
			dx[id].offset = offset;
			offset += sizeof(struct jmp) + sizeof(offset);
		}
	}
	dx[id].jp.n[ij] = -ndely[yy];
	dx[id].jp.x[ij] = xx;
	dx[id].score = dely[yy];
}
if (xx == len0 && yy < len1) {
	/* last col
	 */
	if (endgaps)
		col1[yy] -= ins0+ins1*(len1-yy);
	if (col1[yy] > smax) {
		smax = col1[yy];
		dmax = id;
	}
}
}
if (endgaps && xx < len0)
	col1[yy-1] -= ins0+ins1*(len0-xx);
if (col1[yy-1] > smax) {
	smax = col1[yy-1];
	dmax = id;
}
tmp = col0; col0 = col1; col1 = tmp;
}
(void) free((char *)ndely);
(void) free((char *)dely);
(void) free((char *)col0);
(void) free((char *)col1);		}
```

Table 1 (cont')

```
/*
 *
 * print() -- only routine visible outside this module
 *
 * static:
 * getmat() -- trace back best path, count matches: print()
 * pr_align() -- print alignment of described in array p[]: print()
 * dumpblock() -- dump a block of lines with numbers, stars: pr_align()
 * nums() -- put out a number line: dumpblock()
 * putline() -- put out a line (name, [num], seq, [num]): dumpblock()
 * stars() - -put a line of stars: dumpblock()
 * stripname() -- strip any path and prefix from a seqname
 */

#include "nw.h"

#define SPC       3
#define P_LINE    256       /* maximum output line */
#define P_SPC     3         /* space between name or num and seq */

extern  _day[26][26];
int     olen;               /* set output line length */
FILE    *fx;                /* output file */

print()                                                              print
{
        int     lx, ly, firstgap, lastgap;      /* overlap */

        if ((fx = fopen(ofile, "w")) == 0) {
                fprintf(stderr,"%s: can't write %s\n", prog, ofile);
                cleanup(1);
        }
        fprintf(fx, "<first sequence: %s (length = %d)\n", namex[0], len0);
        fprintf(fx, "<second sequence: %s (length = %d)\n", namex[1], len1);
        olen = 60;
        lx = len0;
        ly = len1;
        firstgap = lastgap = 0;
        if (dmax < len1 - 1) {          /* leading gap in x */
                pp[0].spc = firstgap = len1 - dmax - 1;
                ly -= pp[0].spc;
        }
        else if (dmax > len1 - 1) {     /* leading gap in y */
                pp[1].spc = firstgap = dmax - (len1 - 1);
                lx -= pp[1].spc;
        }
        if (dmax0 < len0 - 1) {         /* trailing gap in x */
                lastgap = len0 - dmax0 -1;
                lx -= lastgap;
        }
        else if (dmax0 > len0 - 1) {    /* trailing gap in y */
                lastgap = dmax0 - (len0 - 1);
                ly -= lastgap;
        }
        getmat(lx, ly, firstgap, lastgap);
        pr_align();
}
```

Table 1 (cont')

getmat

```
/*
 * trace back the best path, count matches
 */
static
getmat(lx, ly, firstgap, lastgap)
        int     lx, ly;                 /* "core" (minus endgaps) */
        int     firstgap, lastgap;      /* leading trailing overlap */
{
        int             nm, i0, i1, siz0, siz1;
        char            outx[32];
        double          pct;
        register        n0, n1;
        register char   *p0, *p1;

        /* get total matches, score
         */
        i0 = i1 = siz0 = siz1 = 0;
        p0 = seqx[0] + pp[1].spc;
        p1 = seqx[1] + pp[0].spc;
        n0 = pp[1].spc + 1;
        n1 = pp[0].spc + 1;

        nm = 0;
        while ( *p0 && *p1 ) {
                if (siz0) {
                        p1++;
                        n1++;
                        siz0--;
                }
                else if (siz1) {
                        p0++;
                        n0++;
                        siz1--;
                }
                else {
                        if (xbm[*p0-'A']&xbm[*p1-'A'])
                                nm++;
                        if (n0++ == pp[0].x[i0])
                                siz0 = pp[0].n[i0++];
                        if (n1++ == pp[1].x[i1])
                                siz1 = pp[1].n[i1++];
                        p0++;
                        p1++;
                }
        }

        /* pct homology:
         * if penalizing endgaps, base is the shorter seq
         * else, knock off overhangs and take shorter core
         */
        if (endgaps)
                lx = (len0 < len1)? len0 : len1;
        else
                lx = (lx < ly)? lx : ly;
        pct = 100.*(double)nm/(double)lx;
        fprintf(fx, "\n");
        fprintf(fx, "<%d match%s in an overlap of %d: %.2f percent similarity\n",
                nm, (nm == 1)? "" : "es", lx, pct);
```

Table 1 (cont')

...getmat

```
	fprintf(fx, "<gaps in first sequence: %d", gapx);
	if (gapx) {
		(void) sprintf(outx, " (%d %s%s)",
			ngapx, (dna)? "base":"residue", (ngapx == 1)? "":"s");
		fprintf(fx,"%s", outx);

	fprintf(fx, ", gaps in second sequence: %d", gapy);
	if (gapy) {
		(void) sprintf(outx, " (%d %s%s)",
			ngapy, (dna)? "base":"residue", (ngapy == 1)? "":"s");
		fprintf(fx,"%s", outx);
	}
	if (dna)
		fprintf(fx,
		"\n<score: %d (match = %d, mismatch = %d, gap penalty = %d + %d per base)\n",
		smax, DMAT, DMIS, DINS0, DINS1);
	else
		fprintf(fx,
		"\n<score: %d (Dayhoff PAM 250 matrix, gap penalty = %d + %d per residue)\n",
		smax, PINS0, PINS1);
	if (endgaps)
		fprintf(fx,
		"<endgaps penalized. left endgap: %d %s%s, right endgap: %d %s%s\n",
		firstgap, (dna)? "base" : "residue", (firstgap == 1)? "" : "s",
		lastgap, (dna)? "base" : "residue", (lastgap == 1)? "" : "s");
	else
		fprintf(fx, "<endgaps not penalized\n");
}

static		nm;		/* matches in core -- for checking */
static		lmax;		/* lengths of stripped file names */
static		ij[2];		/* jmp index for a path */
static		nc[2];		/* number at start of current line */
static		ni[2];		/* current elem number -- for gapping */
static		siz[2];
static char	*ps[2];		/* ptr to current element */
static char	*po[2];		/* ptr to next output char slot */
static char	out[2][P_LINE];	/* output line */
static char	star[P_LINE];	/* set by stars() */

/*
 * print alignment of described in struct path pp[]
 */
static
pr_align()
{
	int		nn;	/* char count */
	int		more;
	register	i;

	for (i = 0, lmax = 0; i < 2; i++) {
		nn = stripname(namex[i]);
		if (nn > lmax)
			lmax = nn;

		nc[i] = 1;
		ni[i] = 1;
		siz[i] = ij[i] = 0;
		ps[i] = seqx[i];
		po[i] = out[i];			}
```

pr_align

Table 1 (cont')

...pr_align

```
	for (nn = nm = 0, more = 1; more; ) {
		for (i = more = 0; i < 2; i++) {
			/*
			 * do we have more of this sequence?
			 */
			if (!*ps[i])
				continue;

			more++;

			if (pp[i].spc) {	/* leading space */
				*po[i]++ = ' ';
				pp[i].spc--;
			}
			else if (siz[i]) {	/* in a gap */
				*po[i]++ = '-';
				siz[i]--;
			}
			else {			/* we're putting a seq element
					 */
				*po[i] = *ps[i];
				if (islower(*ps[i]))
					*ps[i] = toupper(*ps[i]);
				po[i]++;
				ps[i]++;

				/*
				 * are we at next gap for this seq?
				 */
				if (ni[i] == pp[i].x[ij[i]]) {
					/*
					 * we need to merge all gaps
					 * at this location
					 */
					siz[i] = pp[i].n[ij[i]++];
					while (ni[i] == pp[i].x[ij[i]])
						siz[i] += pp[i].n[ij[i]++];
				}
				ni[i]++;
			}
		}
		if (++nn == olen || !more && nn) {
			dumpblock();
			for (i = 0; i < 2; i++)
				po[i] = out[i];
			nn = 0;
		}
	}
}

/*
 * dump a block of lines, including numbers, stars: pr_align()
 */
static
dumpblock()
{
	register i;

	for (i = 0; i < 2; i++)
		*po[i]-- = '\0';
```

dumpblock

Table 1 (cont')

...dumpblock

```
        (void) putc('\n', fx);
        for (i = 0; i < 2; i++) {
                if (*out[i] && (*out[i] != ' ' || *(po[i]) != ' ')) {
                        if (i == 0)
                                nums(i);
                        if (i == 0 && *out[1])
                                stars();
                        putline(i);
                        if (i == 0 && *out[1])
                                fprintf(fx, star);
                        if (i == 1)
                                nums(i);
                }
        }
}

/*
 * put out a number line: dumpblock()
 */
static
nums(ix)
        int     ix;     /* index in out[] holding seq line */
{
        char            nline[P_LINE];
        register        i, j;
        register char   *pn, *px, *py;

        for (pn = nline, i = 0; i < lmax+P_SPC; i++, pn++)
                *pn = ' ';
        for (i = nc[ix], py = out[ix]; *py; py++, pn++) {
                if (*py == ' ' || *py == '-')
                        *pn = ' ';
                else {
                        if (i%10 == 0 || (i == 1 && nc[ix] != 1)) {
                                j = (i < 0)? -i : i;
                                for (px = pn; j; j /= 10, px--)
                                        *px = j%10 + '0';
                                if (i < 0)
                                        *px = '-';
                        }
                        else
                                *pn = ' ';
                        i++;
                }
        }
        *pn = '\0';
        nc[ix] = i;
        for (pn = nline; *pn; pn++)
                (void) putc(*pn, fx);
        (void) putc('\n', fx);
}
```

nums

```
/*
 * put out a line (name, [num], seq, [num]): dumpblock()
 */
static
putline(ix)
        int     ix;                     {
```

putline

Table 1 (cont')

...putline

```
	int		i;
	register char	*px;

	for (px = namex[ix], i = 0; *px && *px != ':'; px++, i++)
		(void) putc(*px, fx);
	for (; i < lmax+P_SPC; i++)
		(void) putc(' ', fx);

	/* these count from 1:
	 * ni[] is current element (from 1)
	 * nc[] is number at start of current line
	 */
	for (px = out[ix]; *px; px++)
		(void) putc(*px&0x7F, fx);
	(void) putc('\n', fx);
}


/*
 * put a line of stars (seqs always in out[0], out[1]): dumpblock()
 */
static
stars()
{
	int		i;
	register char	*p0, *p1, cx, *px;

	if (!*out[0] || (*out[0] == ' ' && *(po[0]) == ' ') ||
	   !*out[1] || (*out[1] == ' ' && *(po[1]) == ' '))
		return;
	px = star;
	for (i = lmax+P_SPC; i; i--)
		*px++ = ' ';

	for (p0 = out[0], p1 = out[1]; *p0 && *p1; p0++, p1++) {
		if (isalpha(*p0) && isalpha(*p1)) {

			if (xbm[*p0-'A']&xbm[*p1-'A']){
				cx = '*';
				nm++;
			}
			else if (!dna && _day[*p0-'A'][*p1-'A'] > 0)
				cx = '.';
			else
				cx = ' ';
		}
		else
			cx = ' ';
		*px++ = cx;
	}
	*px++ = '\n';
	*px = '\0';
}
```

stars

Table 1 (cont')

stripname

```
/*
 * strip path or prefix from pn, return len: pr_align()
 */
static
stripname(pn)
        char    *pn;    /* file name (may be path) */
{
        register char   *px, *py;

        py = 0;
        for (px = pn; *px; px++)
                if (*px == '/')
                        py = px + 1;
        if (py)
                (void) strcpy(pn, py);
        return(strlen(pn));

}
```

Table 1 (cont')

```
/*
 * cleanup() -- cleanup any tmp file
 * getseq() -- read in seq, set dna, len, maxlen
 * g_calloc() -- calloc() with error checkin
 * readjmps() -- get the good jmps, from tmp file if necessary
 * writejmps() -- write a filled array of jmps to a tmp file: nw()
 */
#include "nw.h"
#include <sys/file.h>

char    *jname = "/tmp/homgXXXXXX";            /* tmp file for jmps */
FILE    *fj;

int     cleanup();                             /* cleanup tmp file */
long    lseek();

/*
 * remove any tmp file if we blow
 */
cleanup(i)                                                              cleanup
        int     i;
{
        if (fj)
                (void) unlink(jname);
        exit(i);
}

/*
 * read, return ptr to seq, set dna, len, maxlen
 * skip lines starting with ';', '<', or '>'
 * seq in upper or lower case
 */
char    *
getseq(file, len)                                                       getseq
        char    *file;  /* file name */
        int     *len;   /* seq len */
{
        char            line[1024], *pseq;
        register char   *px, *py;
        int             natgc, tlen;
        FILE            *fp;

        if ((fp = fopen(file,"r")) == 0) {
                fprintf(stderr,"%s: can't read %s\n", prog, file);
                exit(1);
        }
        tlen = natgc = 0;
        while (fgets(line, 1024, fp)) {
                if (*line == ';' || *line == '<' || *line == '>')
                        continue;
                for (px = line; *px != '\n'; px++)
                        if (isupper(*px) || islower(*px))
                                tlen++;
        }
        if ((pseq = malloc((unsigned)(tlen+6))) == 0) {
                fprintf(stderr,"%s: malloc() failed to get %d bytes for %s\n", prog, tlen+6, file);
                exit(1);
        }
        pseq[0] = pseq[1] = pseq[2] = pseq[3] = '\0';
```

Table 1 (cont')

...getseq

```
        py = pseq + 4;
        *len = tlen;
        rewind(fp);

        while (fgets(line, 1024, fp)) {
                if (*line == ';' || *line == '<' || *line == '>')
                        continue;
                for (px = line; *px != '\n'; px++){
                        if (isupper(*px))
                                *py++ = *px;
                        else if (islower(*px))
                                *py++ = toupper(*px);
                        if (index("ATGCU",*(py-1)))
                                natgc++;
                }
        }
        *py++ = '\0';
        *py = '\0';
        (void) fclose(fp);
        dna = natgc > (tlen/3);
        return(pseq+4);
}

char    *
g_calloc(msg, nx, sz)
```

g_calloc

```
        char    *msg;           /* program, calling routine */
        int     nx, sz;         /* number and size of elements */
{
        char            *px, *calloc();

        if ((px = calloc((unsigned)nx, (unsigned)sz)) == 0) {
                if (*msg) {
                        fprintf(stderr, "%s: g_calloc() failed %s (n=%d, sz=%d)\n", prog, msg, nx, sz);
                        exit(1);
                }
        }
        return(px);
}

/*
 * get final jmps from dx[] or tmp file, set pp[], reset dmax: main()
 */
readjmps()
```

readjmps

```
{
        int             fd = -1;
        int             siz, i0, i1;
        register  i, j, xx;

        if (fj) {
                (void) fclose(fj);
                if ((fd = open(jname, O_RDONLY, 0)) < 0) {
                        fprintf(stderr, "%s: can't open() %s\n", prog, jname);
                        cleanup(1);
                }
        }
        for (i = i0 = i1 = 0, dmax0 = dmax, xx = len0; ; i++) {
                while (1) {
                        for (j = dx[dmax].ijmp; j >= 0 && dx[dmax].jp.x[j] >= xx; j--)
                                ;
```

Table 1 (cont')

...readjmps

```
			if (j < 0 && dx[dmax].offset && fj) {
				(void) lseek(fd, dx[dmax].offset, 0);
				(void) read(fd, (char *)&dx[dmax].jp, sizeof(struct jmp));
				(void) read(fd, (char *)&dx[dmax].offset, sizeof(dx[dmax].offset));
				dx[dmax].ijmp = MAXJMP-1;
			}
			else
				break;
		}
		if (i >= JMPS) {
			fprintf(stderr, "%s: too many gaps in alignment\n", prog);
			cleanup(1);
		}
		if (j >= 0) {
			siz = dx[dmax].jp.n[j];
			xx = dx[dmax].jp.x[j];
			dmax += siz;
			if (siz < 0) {			/* gap in second seq */
				pp[1].n[i1] = -siz;
				xx += siz;
				/* id = xx - yy + len1 - 1
				 */
				pp[1].x[i1] = xx - dmax + len1 - 1;
				gapy++;
				ngapy -= siz;
/* ignore MAXGAP when doing endgaps */
				siz = (-siz < MAXGAP || endgaps)? -siz : MAXGAP;
				i1++;
			}
			else if (siz > 0) {	/* gap in first seq */
				pp[0].n[i0] = siz;
				pp[0].x[i0] = xx;
				gapx++;
				ngapx += siz;
/* ignore MAXGAP when doing endgaps */
				siz = (siz < MAXGAP || endgaps)? siz : MAXGAP;
				i0++;
			}
		}
		else
			break;
	}

	/* reverse the order of jmps
	 */
	for (j = 0, i0--; j < i0; j++, i0--) {
		i = pp[0].n[j]; pp[0].n[j] = pp[0].n[i0]; pp[0].n[i0] = i;
		i = pp[0].x[j]; pp[0].x[j] = pp[0].x[i0]; pp[0].x[i0] = i;
	}
	for (j = 0, i1--; j < i1; j++, i1--) {
		i = pp[1].n[j]; pp[1].n[j] = pp[1].n[i1]; pp[1].n[i1] = i;
		i = pp[1].x[j]; pp[1].x[j] = pp[1].x[i1]; pp[1].x[i1] = i;
	}
	if (fd >= 0)
		(void) close(fd);
	if (fj) {
		(void) unlink(jname);
		fj = 0;
		offset = 0;
	}				}
```

Table 1 (cont')

writejmps

```
/*
 * write a filled jmp struct offset of the prev one (if any): nw()
 */
writejmps(ix)
        int     ix;
{
        char    *mktemp();

        if (!fj) {
                if (mktemp(jname) < 0) {
                        fprintf(stderr, "%s: can't mktemp() %s\n", prog, jname);
                        cleanup(1);
                }
                if ((fj = fopen(jname, "w")) == 0) {
                        fprintf(stderr, "%s: can't write %s\n", prog, jname);
                        exit(1);
                }
        }
        (void) fwrite((char *)&dx[ix].jp, sizeof(struct jmp), 1, fj);
        (void) fwrite((char *)&dx[ix].offset, sizeof(dx[ix].offset), 1, fj);
}
```

TABLE 2

| | | |
|---|---|---|
| PRO | XXXXXXXXXXXXXXX | (Length = 15 amino acids) |
| Comparison Protein | XXXXXYYYYYYY | (Length = 12 amino acids) |

% amino acid sequence identity = (the number of identically matching amino acid residues between the two polypeptide sequences as determined by ALIGN-2) divided by (the total number of amino acid residues of the PRO polypeptide) = 5 divided by 15 = 33.3%

TABLE 3

| | | |
|---|---|---|
| PRO | XXXXXXXXXX | (Length = 10 amino acids) |
| Comparison Protein | XXXXXYYYYYYZZYZ | (Length = 15 amino acids) |

% amino acid sequence identity = (the number of identically matching amino acid residues between the two polypeptide sequences as determined by ALIGN-2) divided by (the total number of amino acid residues of the PRO polypeptide) = 5 divided by 10 = 50%

TABLE 4

| | | |
|---|---|---|
| PRO-DNA | NNNNNNNNNNNNNN | (Length = 14 nucleotides) |
| Comparison DNA | NNNNNNLLLLLLLLLL | (Length = 16 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 6 divided by 14 = 42.9%

TABLE 5

| | | |
|---|---|---|
| PRO-DNA | NNNNNNNNNNNN | (Length = 12 nucleotides) |
| Comparison DNA | NNNNLLLVV | (Length = 9 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 4 divided by 12 = 33.3%

II. Compositions and Methods of the Invention

A. Full-Length PRO Polypeptides

The present invention provides newly identified and isolated nucleotide sequences encoding polypeptides referred to in the present application as PRO polypeptides. In particular, cDNAs encoding various PRO polypeptides have been identified and isolated, as disclosed in further detail in the Examples below. It is noted that proteins produced in separate expression rounds may be given different PRO numbers but the UNQ number is unique for any given DNA and the encoded protein, and will not be changed. However, for sake of simplicity, in the present specification the protein encoded by the full length native nucleic acid molecules disclosed herein as well as all further native homologues and variants included in the foregoing definition of PRO, will be referred to as "PRO/number", regardless of their origin or mode of preparation.

As disclosed in the Examples below, various cDNA clones have been deposited with the ATCC. The actual nucleotide sequences of those clones can readily be determined by the skilled artisan by sequencing of the deposited clone using routine methods in the art. The predicted amino acid sequence can be determined from the nucleotide sequence using routine skill. For the PRO polypeptides and encoding nucleic acids described herein, Applicants have identified what is believed to be the reading frame best identifiable with the sequence information available at the time.

B. PRO Polypeptide Variants

In addition to the full-length native sequence PRO polypeptides described herein, it is contemplated that PRO variants can be prepared. PRO variants can be prepared by introducing appropriate nucleotide changes into the PRO DNA, and/or by synthesis of the desired PRO polypeptide. Those skilled in the art will appreciate that amino acid changes may alter post-translational processes of the PRO, such as changing the number or position of glycosylation sites or altering the membrane anchoring characteristics.

Variations in the native full-length sequence PRO or in various domains of the PRO described herein, can be made, for example, using any of the techniques and guidelines for conservative and non-conservative mutations set forth, for instance, in U.S. Pat. No. 5,364,934. Variations may be a substitution, deletion or insertion of one or more codons encoding the PRO that results in a change in the amino acid sequence of the PRO as compared with the native sequence PRO. Optionally the variation is by substitution of at least one amino acid with any other amino acid in one or more of the domains of the PRO. Guidance in determining which amino acid residue may be inserted, substituted or deleted without adversely affecting the desired activity may be found by comparing the sequence of the PRO with that of homologous known protein molecules and minimizing the number of amino acid sequence changes made in regions of high homology. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence.

PRO polypeptide fragments are provided herein. Such fragments may be truncated at the N-terminus or C-terminus, or may lack internal residues, for example, when compared with a full length native protein. Certain fragments lack amino acid residues that are not essential for a desired biological activity of the PRO polypeptide.

PRO fragments may be prepared by any of a number of conventional techniques. Desired peptide fragments may be chemically synthesized. An alternative approach involves generating PRO fragments by enzymatic digestion, e.g., by treating the protein with an enzyme known to cleave proteins at sites defined by particular amino acid residues, or by digesting the DNA with suitable restriction enzymes and isolating the desired fragment. Yet another suitable technique involves isolating and amplifying a DNA fragment encoding a desired polypeptide fragment, by polymerase chain reaction (PCR). Oligonucleotides that define the desired termini of the DNA fragment are employed at the 5' and 3' primers in the PCR. Preferably, PRO polypeptide fragments share at least one biological and/or immunological activity with the native PRO polypeptide disclosed herein.

In particular embodiments, conservative substitutions of interest are shown in Table 6 under the heading of preferred substitutions. If such substitutions result in a change in biological activity, then more substantial changes, denominated exemplary substitutions in Table 6, or as further described below in reference to amino acid classes, are introduced and the products screened.

TABLE 6

| Original Residue | Exemplary Substitutions | Preferred Substitutions |
|---|---|---|
| Ala (A) | val; leu; ile | val |
| Arg (R) | lys; gln; asn | lys |
| Asn (N) | gln; his; lys; arg | gln |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Substantial modifications in function or immunological identity of the PRO polypeptide are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:

(1) hydrophobic: norleucine, met, ala, val, leu, ile;
(2) neutral hydrophilic: cys, ser, thr;
(3) acidic: asp, glu;
(4) basic: asn, gin, his, lys, arg;
(5) residues that influence chain orientation: gly, pro; and
(6) aromatic: trp, tyr, phe.

Non-conservative substitutions will entail exchanging a member of one of these classes for another class. Such substituted residues also may be introduced into the conservative substitution sites or, more preferably, into the remaining (non-conserved) sites.

The variations can be made using methods known in the art such as oligonucleotide-mediated (site-directed) mutagenesis, alanine scanning, and PCR mutagenesis. Site-directed mutagenesis [Carter et al., *Nucl. Acids Res.,* 13:4331 (1986); Zoller et al., *Nucl. Acids Res.,* 10:6487 (1987)], cassette mutagenesis [Wells et al., *Gene,* 34:315 (1985)], restriction selection mutagenesis [Wells et al., *Philos. Trans. R. Soc. London SerA,* 317:415 (1986)] or other known techniques can be performed on the cloned DNA to produce the PRO variant DNA.

Scanning amino acid analysis can also be employed to identify one or more amino acids along a contiguous sequence. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant [Cunningham and Wells, *Science,* 244: 1081-1085 (1989)]. Alanine is also typically preferred because it is the most common amino acid. Further, it is frequently found in both buried and exposed positions [Creighton, *The Proteins,* (W.H. Freeman & Co., N.Y.); Chothia, *J. Mol. Biol.,* 150:1 (1976)]. If alanine substitution does not yield adequate amounts of variant, an isoteric amino acid can be used.

C. Modifications of PRO

Covalent modifications of PRO are included within the scope of this invention. One type of covalent modification includes reacting targeted amino acid residues of a PRO polypeptide with an organic derivatizing agent that is capable of reacting with selected side chains or the N- or C-terminal residues of the PRO. Derivatization with bifunctional agents is useful, for instance, for crosslinking PRO to a water-insoluble support matrix or surface for use in the method for purifying anti-PRO antibodies, and vice-versa. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate),bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the α-amino groups of lysine, arginine, and histidine side chains [T. E. Creighton, *Proteins: Structure and Molecular Properties,* W.H. Freeman & Co., San Francisco, pp. 79-86 (1983)], acetylation of the N-terminal amine, and amidation of any C-terminal carboxyl group.

Another type of covalent modification of the PRO polypeptide included within the scope of this invention comprises altering the native glycosylation pattern of the polypeptide. “Altering the native glycosylation pattern” is intended for purposes herein to mean deleting one or more carbohydrate moieties found in native sequence PRO (either by removing the underlying glycosylation site or by deleting the glycosylation by chemical and/or enzymatic means), and/or adding one or more glycosylation sites that are not present in the native sequence PRO. In addition, the phrase includes qualitative changes in the glycosylation of the native proteins, involving a change in the nature and proportions of the various carbohydrate moieties present.

Addition of glycosylation sites to the PRO polypeptide may be accomplished by altering the amino acid sequence. The alteration may be made, for example, by the addition of, or substitution by, one or more serine or threonine residues to the native sequence PRO (for O-linked glycosylation sites). The PRO amino acid sequence may optionally be altered through changes at the DNA level, particularly by mutating the DNA encoding the PRO polypeptide at preselected bases such that codons are generated that will translate into the desired amino acids.

Another means of increasing the number of carbohydrate moieties on the PRO polypeptide is by chemical or enzymatic coupling of glycosides to the polypeptide. Such methods are described in the art, e.g., in WO 87/05330 published 11 Sep. 1987, and in Aplin and Wriston, *CRC Crit. Rev. Biochem.,* pp. 259-306 (1981).

Removal of carbohydrate moieties present on the PRO polypeptide may be accomplished chemically or enzymatically or by mutational substitution of codons encoding for amino acid residues that serve as targets for glycosylation. Chemical deglycosylation techniques are known in the art and described, for instance, by Hakimuddin, et al., *Arch. Biochem. Biophys.,* 259:52 (1987) and by Edge et al., *Anal. Biochem.,* 118:131 (1981). Enzymatic cleavage of carbohydrate moieties on polypeptides can be achieved by the use of a variety of endo- and exo-glycosidases as described by Thotakura et al., *Meth. Enzymol.,* 138:350 (1987).

Another type of covalent modification of PRO comprises linking the PRO polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or U.S. Pat. No. 4,179,337.

The PRO of the present invention may also be modified in a way to form a chimeric molecule comprising PRO fused to another, heterologous polypeptide or amino acid sequence.

In one embodiment, such a chimeric molecule comprises a fusion of the PRO with a tag polypeptide which provides an epitope to which an anti-tag antibody can selectively bind. The epitope tag is generally placed at the amino- or carboxyl-terminus of the PRO. The presence of such epitope-tagged forms of the PRO can be detected using an antibody against the tag polypeptide. Also, provision of the epitope tag enables the PRO to be readily purified by affinity purification using an anti-tag antibody or another type of affinity matrix that binds to the epitope tag. Various tag polypeptides and their respective antibodies are well known in the art. Examples include poly-histidine (poly-his) or poly-histidine-glycine (poly-his-gly) tags; the flu HA tag polypeptide and its antibody 12CA5 [Field et al., *Mol. Cell. Biol.,* 8:2159-2165 (1988)]; the c-myc tag and the 8F9, 3C7, 6E10, G4, B7 and 9E10 antibodies thereto [Evan et al., *Molecular and Cellular Biology,* 5:3610-3616 (1985)]; and the Herpes Simplex virus glycoprotein D (gD) tag and its antibody [Paborsky et al., *Protein Engineering,* 3(6):547-553 (1990)]. Other tag polypeptides include the Flag-peptide [Hopp et al., *BioTechnology,* 6:1204-1210 (1988)]; the KT3 epitope peptide [Martin et al., *Science,* 255:192-194 (1992)]; an α-tubulin epitope peptide [Skinner et al., *J. Biol. Chem,* 266:15163-15166 (1991)]; and the T7 gene 10 protein peptide tag [Lutz-Freyermuth et al., *Proc. Natl. Acad. Sci. USA,* 87:6393-6397 (1990)].

In an alternative embodiment, the chimeric molecule may comprise a fusion of the PRO with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a PRO polypeptide in place of at least one variable region within an Ig molecule. In a particularly preferred embodiment, the immunoglobulin fusion includes the hinge, CH2 and CH3, or the hinge, CH1, CH2 and CH3 regions of an IgG1 molecule. For the production of immunoglobulin fusions see also U.S. Pat. No. 5,428,130 issued Jun. 27, 1995.

D. Preparation of PRO

The description below relates primarily to production of PRO by culturing cells transformed or transfected with a vector containing PRO nucleic acid. It is, of course, contemplated that alternative methods, which are well known in the art, may be employed to prepare PRO. For instance, the PRO sequence, or portions thereof, may be produced by direct peptide synthesis using solid-phase techniques [see, e.g., Stewart et al., *Solid-Phase Peptide Synthesis,* W.H. Freeman Co., San Francisco, Calif. (1969); Merrifield, *J. Am. Chem. Soc.,* 85:2149-2154 (1963)]. In vitro protein synthesis may be performed using manual techniques or by automation. Automated synthesis may be accomplished, for instance, using an Applied Biosystems Peptide Synthesizer (Foster City, Calif.) using manufacturer's instructions. Various portions of the PRO may be chemically synthesized separately and combined using chemical or enzymatic methods to produce the full-length PRO.

1. Isolation of DNA Encoding PRO

DNA encoding PRO may be obtained from a cDNA library prepared from tissue believed to possess the PRO mRNA and to express it at a detectable level. Accordingly, human PRO DNA can be conveniently obtained from a cDNA library prepared from human tissue, such as described in the Examples. The PRO-encoding gene may also be obtained from a genomic library or by known synthetic procedures (e.g., automated nucleic acid synthesis).

Libraries can be screened with probes (such as antibodies to the PRO or oligonucleotides of at least about 20-80 bases) designed to identify the gene of interest or the protein encoded by it. Screening the cDNA or genomic library with the selected probe may be conducted using standard procedures, such as described in Sambrook et al., *Molecular Cloning: A Laboratory Manual* (New York: Cold Spring Harbor Laboratory Press, 1989). An alternative means to isolate the gene encoding PRO is to use PCR methodology [Sambrook et al., supra; Dieffenbach et al., *PCR Primer: A Laboratory Manual* (Cold Spring Harbor Laboratory Press, 1995)].

The Examples below describe techniques for screening a cDNA library. The oligonucleotide sequences selected as probes should be of sufficient length and sufficiently unambiguous that false positives are minimized. The oligonucleotide is preferably labeled such that it can be detected upon hybridization to DNA in the library being screened. Methods of labeling are well known in the art, and include the use of radiolabels like $^{32}$P-labeled ATP, biotinylation or enzyme labeling. Hybridization conditions, including moderate stringency and high stringency, are provided in Sambrook et al., supra.

Sequences identified in such library screening methods can be compared and aligned to other known sequences deposited and available in public databases such as GenBank or other private sequence databases. Sequence identity (at either the amino acid or nucleotide level) within defined regions of the molecule or across the full-length sequence can be determined using methods known in the art and as described herein.

Nucleic acid having protein coding sequence may be obtained by screening selected cDNA or genomic libraries using the deduced amino acid sequence disclosed herein for the first time, and, if necessary, using conventional primer extension procedures as described in Sambrook et al., supra, to detect precursors and processing intermediates of mRNA that may not have been reverse-transcribed into cDNA.

2. Selection and Transformation of Host Cells

Host cells are transfected or transformed with expression or cloning vectors described herein for PRO production and cultured in conventional nutrient media modified as appropriate for inducing promoters, selecting transformants, or amplifying the genes encoding the desired sequences. The culture conditions, such as media, temperature, pH and the like, can be selected by the skilled artisan without undue experimentation. In general, principles, protocols, and practical techniques for maximizing the productivity of cell cultures can be found in *Mammalian Cell BioTechnology: a Practical Approach,* M. Butler, ed. (IRL Press, 1991) and Sambrook et al., supra.

Methods of eukaryotic cell transfection and prokaryotic cell transformation are known to the ordinarily skilled artisan, for example, $CaCl_2$, $CaPO_4$, liposome-mediated and electroporation. Depending on the host cell used, transformation is performed using standard techniques appropriate to such cells. The calcium treatment employing calcium chloride, as described in Sambrook et al., supra, or electroporation is generally used for prokaryotes. Infection with *Agrobacterium*

*tumefaciens* is used for transformation of certain plant cells, as described by Shaw et al., *Gene,* 23:315 (1983) and WO 89/05859 published 29 Jun. 1989. For mammalian cells without such cell walls, the calcium phosphate precipitation method of Graham and van der Eb, *Virology,* 52:456-457 (1978) can be employed. General aspects of mammalian cell host system transfections have been described in U.S. Pat. No. 4,399,216. Transformations into yeast are typically carried out according to the method of Van Solingen et al., *J. Bact.,* 130:946 (1977) and Hsiao et al., *Proc. Natl. Acad. Sci.* (*USA*), 76:3829 (1979). However, other methods for introducing DNA into cells, such as by nuclear microinjection, electroporation, bacterial protoplast fusion with intact cells, or polycations, e.g., polybrene, polyornithine, may also be used. For various techniques for transforming mammalian cells, see Keown et al., *Methods in Enzymology,* 185:527-537 (1990) and Mansour et al., *Nature,* 336:348-352 (1988).

Suitable host cells for cloning or expressing the DNA in the vectors herein include prokaryote, yeast, or higher eukaryote cells. Suitable prokaryotes include but are not limited to eubacteria, such as Gram-negative or Gram-positive organisms, for example, Enterobacteriaceae such as *E. coli.* Various *E. coli* strains are publicly available, such as *E. coli* K12 strain MM294 (ATCC 31,446); *E. coli* X1776 (ATCC 31,537); *E. coli* strain W3110 (ATCC 27,325) and K5 772 (ATCC 53,635). Other suitable prokaryotic host cells include Enterobacteriaceae such as *Escherichia,* e.g., *E. coli, Enterobacter, Erwinia, Klebsiella, Proteus, Salmonella,* e.g., *Salmonella typhimurium, Serratia,* e.g., *Serratia marcescans,* and *Shigella,* as well as *Bacilli* such as *B. subtilis* and *B. licheniformis* (e.g., *B. licheniformis* 41P disclosed in DD 266,710 published 12 Apr. 1989), *Pseudomonas* such as *P. aeruginosa,* and *Streptomyces.* These examples are illustrative rather than limiting. Strain W3110 is one particularly preferred host or parent host because it is a common host strain for recombinant DNA product fermentations. Preferably, the host cell secretes minimal amounts of proteolytic enzymes. For example, strain W3 110 may be modified to effect a genetic mutation in the genes encoding proteins endogenous to the host, with examples of such hosts including *E. coli* W3110 strain 1A2, which has the complete genotype tonA; *E. coli* W3110 strain 9E4, which has the complete genotype tonA ptr3; *E. coli* W3110 strain 27C7 (ATCC 55,244), which has the complete genotype tonA ptr3phoA E15 (argF-lac) 169 degP ompT $kan^r$; *E. coli* W3110 strain 37D6, which has the complete genotype tonA ptr3 phoA E15 (argF-lac)169 degP ompT rbs7 ilvG $kan^r$; *E. coli* W3110 strain 40B4; which is strain 37D6 with a non-kanamycin resistant degP deletion mutation; and an *E. coli* strain having mutant periplasmic protease disclosed in U.S. Pat. No. 4,946,783 issued 7 Aug. 1990. Alternatively, in vitro methods of cloning, e.g., PCR or other nucleic acid polymerase reactions, are suitable.

In addition to prokaryotes, eukaryotic microbes such as filamentous fungi or yeast are suitable cloning or expression hosts for PRO-encoding vectors. *Saccharomyces cerevisiae* is a commonly used lower eukaryotic host microorganism. Others include *Schizosaccharomyces pombe* (Beach and Nurse, *Nature,* 290:140 [1981]; EP 139,383 published 2 May 1985); Kluyveromyces hosts (U.S. Pat. No. 4,943,529; Fleer et al., *Bio/Technology,*9:968-975(1991)) such as, e.g., *K. lactis* (MW98-8C, CBS683, CBS4574; Louvencourt et al., *J. Bacteriol.,* 154(2):737-742 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., *Bio/Technoloy,* 8:135 (1990)), *K. thermotolerans,* and *K. marxianus; yarrowia* (EP 402,226); *Pichia pastoris* (EP 183,070; Sreekrishna et al., *J. Basic Microbiol.,* 28:265-278 [1988]); *Candida; Trichoderma reesia* (EP 244,234); *Neurospora crassa* (Case et al., *Proc. Natl. Acad. Sci. USA,* 76:5259-5263 [1979]); *Schwanniomyces* such as *Schwanniomyces occidentalis* (EP 394,538 published 31 Oct. 1990); and filamentous fungi such as, e.g., *Neurospora, Penicillium, Tolypocladium* (WO 91/00357 published 10 Jan. 1991), and *Aspergillus* hosts such as *A. nidulans* (Ballance et al., *Biochem. Biophys. Res. Commun.,* 112: 284-289 [1983]; Tilburn et al., *Gene,* 26:205-221 [1983]; Yelton et al., *Proc. Natl. Acad. Sci. USA,* 81: 1470-1474 [1984]) and *A. niger* (Kelly and Hynes, *EMBO J.,* 4:475-479 [1985]). Methylotropic yeasts are suitable herein and include, but are not limited to, yeast capable of growth on methanol selected from the genera consisting of *Hansenula, Candida, Kloeckera, Pichia, Saccharomyces, Torulopsis,* and *Rhodotorula.* A list of specific species that are exemplary of this class of yeasts may be found in C. Anthony, *The Biochemistry of Methylotrophs,* 269 (1982).

Suitable host cells for the expression of glycosylated PRO are derived from multicellular organisms. Examples of invertebrate cells include insect cells such as *Drosophila* S2 and *Spodoptera* Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., *J. Gen Virol.,* 36:59 (1977)); Chinese hamster ovary cells/-DHFR (CHO, Urlaub and Chasin, *Proc. Natl. Acad. Sci. USA,* 77:4216 (1980)); mouse sertoli cells (TM4, Mather, *Biol. Reprod.,* 23:243-251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art.

3. Selection and Use of a Replicable Vector

The nucleic acid (e.g., cDNA or genomic DNA) encoding PRO may be inserted into a replicable vector for cloning (amplification of the DNA) or for expression. Various vectors are publicly available. The vector may, for example, be in the form of a plasmid, cosmid, viral particle, or phage. The appropriate nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan.

The PRO may be produced recombinantly not only directly, but also as a fusion polypeptide with a heterologous polypeptide, which may be a signal sequence or other polypeptide having a specific cleavage site at the N-terminus of the mature protein or polypeptide. In general, the signal sequence may be a component of the vector, or it may be a part of the PRO-encoding DNA that is inserted into the vector. The signal sequence may be a prokaryotic signal sequence selected, for example, from the group of the alkaline phosphatase, penicillinase, lpp, or heat-stable enterotoxin II leaders. For yeast secretion the signal sequence may be, e.g., the yeast invertase leader, alpha factor leader (including Saccharomyces and Kluyveromyces α-factor leaders, the latter described in U.S. Pat. No. 5,010,182), or acid phosphatase leader, the *C. albicans* glucoamylase leader (EP 362,179 published 4 Apr. 1990), or the signal described in WO 90/13646 published 15 Nov. 1990. In mammalian cell expression, mammalian signal sequences may be used to direct secretion of the protein, such as signal sequences from secreted polypeptides of the same or related species, as well as viral secretory leaders.

Both expression and cloning vectors contain a nucleic acid sequence that enables the vector to replicate in one or more selected host cells. Such sequences are well known for a variety of bacteria, yeast, and viruses. The origin of replication from the plasmid pBR322 is suitable for most Gram-negative bacteria, the 2μ plasmid origin is suitable for yeast, and various viral origins (SV40, polyoma, adenovirus, VSV or BPV) are useful for cloning vectors in mammalian cells.

Expression and cloning vectors will typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

An example of suitable selectable markers for mammalian cells are those that enable the identification of cells competent to take up the PRO-encoding nucleic acid, such as DHFR or thymidine kinase. An appropriate host cell when wild-type DHFR is employed is the CHO cell line deficient in DHFR activity, prepared and propagated as described by Urlaub et al., *Proc. Natl. Acad. Sci. USA,* 77:4216 (1980). A suitable selection gene for use in yeast is the trp1 gene present in the yeast plasmid YRp7 [Stinchcomb et al., *Nature,* 282:39 (1979); Kingsman et al., *Gene,* 7:141 (1979); Tschemper et al., *Gene,* 10:157 (1980)]. The trp1 gene provides a selection marker for a mutant strain of yeast lacking the ability to grow in tryptophan, for example, ATCC No. 44076 or PEP4-1 [Jones, *Genetics,* 85:12 (1977)].

Expression and cloning vectors usually contain a promoter operably linked to the PRO-encoding nucleic acid sequence to direct mRNA synthesis. Promoters recognized by a variety of potential host cells are well known. Promoters suitable for use with prokaryotic hosts include the β-lactamase and lactose promoter systems [Chang et al., *Nature,* 275:615 (1978); Goeddel et al., *Nature,* 281:544 (1979)], alkaline phosphatase, a tryptophan (trp) promoter system [Goeddel, *Nucleic Acids Res.,* 8:4057 (1980); EP 36,776], and hybrid promoters such as the tac promoter [deBoer et al., *Proc. Natl. Acad. Sci. USA,* 80:21-25 (1983)]. Promoters for use in bacterial systems also will contain a Shine-Dalgarno (S.D.) sequence operably linked to the DNA encoding PRO.

Examples of suitable promoting sequences for use with yeast hosts include the promoters for 3-phosphoglycerate kinase [Hitzeman et al., *J. Biol. Chem.,* 255:2073 (1980)] or other glycolytic enzymes [Hess et al., *J. Adv. Enzyme Reg.,* 7:149 (1968); Holland, *Biochemistry,* 17:4900 (1978)], such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657.

PRO transcription from vectors in mammalian host cells is controlled, for example, by promoters obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, and from heat-shock promoters, provided such promoters are compatible with the host cell systems.

Transcription of a DNA encoding the PRO by higher eukaryotes may be increased by inserting an enhancer sequence into the vector. Enhancers are cis-acting elements of DNA, usually about from 10 to 300 bp, that act on a promoter to increase its transcription. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (bp 100-270), the cytomegalovirus early promoter enhancer, the polyoma enhancer on the late side of the replication origin, and adenovirus enhancers. The enhancer may be spliced into the vector at a position 5' or 3' to the PRO coding sequence, but is preferably located at a site 5' from the promoter.

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding PRO.

Still other methods, vectors, and host cells suitable for adaptation to the synthesis of PRO in recombinant vertebrate cell culture are described in Gething et al., *Nature,* 293:620-625 (1981); Mantei et al., *Nature,* 281:40-46 (1979); EP 117,060; and EP 117,058.

4. Detecting Gene Amplification/Expression

Gene amplification and/or expression may be measured in a sample directly, for example, by conventional Southern blotting, Northern blotting to quantitate the transcription of mRNA [Thomas, *Proc. Natl. Acad. Sci. USA,* 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological methods, such as immunohistochemical staining of cells or tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence PRO polypeptide or against a synthetic peptide based on the DNA sequences provided herein or against exogenous sequence fused to PRO DNA and encoding a specific antibody epitope.

5. Purification of Polypeptide

Forms of PRO may be recovered from culture medium or from host cell lysates. If membrane-bound, it can be released from the membrane using a suitable detergent solution (e.g. Triton-X 100) or by enzymatic cleavage. Cells employed in expression of PRO can be disrupted by various physical or chemical means, such as freeze-thaw cycling, sonication, mechanical disruption, or cell lysing agents.

It may be desired to purify PRO from recombinant cell proteins or polypeptides. The following procedures are exemplary of suitable purification procedures: by fractionation on an ion-exchange column; ethanol precipitation; reverse phase HPLC; chromatography on silica or on a cation-exchange resin such as DEAE; chromatofocusing; SDS-PAGE; ammonium sulfate precipitation; gel filtration using, for example, Sephadex G-75; protein A Sepharose columns to remove contaminants such as IgG; and metal chelating columns to bind epitope-tagged forms of the PRO. Various methods of protein purification may be employed and such methods are known in the art and described for example in Deutscher, *Methods in Enzymology,* 182 (1990); Scopes, *Protein Purification: Principles and Practice,* Springer-Verlag, New York (1982). The purification step(s) selected will depend, for example, on the nature of the production process used and the particular PRO produced.

E. Uses for PRO

Nucleotide sequences (or their complement) encoding PRO have various applications in the art of molecular biology, including uses as hybridization probes, in chromosome and gene mapping and in the generation of anti-sense RNA and DNA. PRO nucleic acid will also be useful for the preparation of PRO polypeptides by the recombinant techniques described herein.

The full-length native sequence PRO gene, or portions thereof, may be used as hybridization probes for a cDNA library to isolate the full-length PRO cDNA or to isolate still other cDNAs (for instance, those encoding naturally-occurring variants of PRO or PRO from other species) which have a desired sequence identity to the native PRO sequence disclosed herein. Optionally, the length of the probes will be about 20 to about 50 bases. The hybridization probes may be derived from at least partially novel regions of the full length native nucleotide sequence wherein those regions may be determined without undue experimentation or from genomic sequences including promoters, enhancer elements and introns of native sequence PRO. By way of example, a screening method will comprise isolating the coding region of the PRO gene using the known DNA sequence to synthesize a selected probe of about 40 bases. Hybridization probes may be labeled by a variety of labels, including radionucleotides such as $^{32}P$ or $^{35}S$, or enzymatic labels such as alkaline phosphatase coupled to the probe via avidin/biotin coupling systems. Labeled probes having a sequence complementary to that of the PRO gene of the present invention can be used to screen libraries of human cDNA, genomic DNA or mRNA to determine which members of such libraries the probe hybridizes to. Hybridization techniques are described in further detail in the Examples below.

Any EST sequences disclosed in the present application may similarly be employed as probes, using the methods disclosed herein.

Other useful fragments of the PRO nucleic acids include antisense or sense oligonucleotides comprising a singe-stranded nucleic acid sequence (either RNA or DNA) capable of binding to target PRO mRNA (sense) or PRO DNA (antisense) sequences. Antisense or sense oligonucleotides, according to the present invention, comprise a fragment of the coding region of PRO DNA. Such a fragment generally comprises at least about 14 nucleotides, preferably from about 14 to 30 nucleotides. The ability to derive an antisense or a sense oligonucleotide, based upon a cDNA sequence encoding a given protein is described in, for example, Stein and Cohen (*Cancer Res.* 48:2659, 1988) and van der Krol et al. (*BioTechniques* 6:958, 1988).

Binding of antisense or sense oligonucleotides to target nucleic acid sequences results in the formation of duplexes that block transcription or translation of the target sequence by one of several means, including enhanced degradation of the duplexes, premature termination of transcription or translation, or by other means. The antisense oligonucleotides thus may be used to block expression of PRO proteins. Antisense or sense oligonucleotides further comprise oligonucleotides having modified sugar-phosphodiester backbones (or other sugar linkages, such as those described in WO 91/06629) and wherein such sugar linkages are resistant to endogenous nucleases. Such oligonucleotides with resistant sugar linkages are stable in vivo (i.e., capable of resisting enzymatic degradation) but retain sequence specificity to be able to bind to target nucleotide sequences.

Other examples of sense or antisense oligonucleotides include those oligonucleotides which are covalently linked to organic moieties, such as those described in WO 90/10048, and other moieties that increases affinity of the oligonucleotide for a target nucleic acid sequence, such as poly-(L-lysine). Further still, intercalating agents, such as ellipticine, and alkylating agents or metal complexes may be attached to sense or antisense oligonucleotides to modify binding specificities of the antisense or sense oligonucleotide for the target nucleotide sequence.

Antisense or sense oligonucleotides may be introduced into a cell containing the target nucleic acid sequence by any gene transfer method, including, for example, $CaPO_4$-mediated DNA transfection, electroporation, or by using gene transfer vectors such as Epstein-Barr virus. In a preferred procedure, an antisense or sense oligonucleotide is inserted into a suitable retroviral vector. A cell containing the target nucleic acid sequence is contacted with the recombinant retroviral vector, either in vivo or ex vivo. Suitable retroviral vectors include, but are not limited to, those derived from the murine retrovirus M-MuLV, N2 (a retrovirus derived from M-MuLV), or the double copy vectors designated DCT5A, DCT5B and DCT5C (see WO 90/13641).

Sense or antisense oligonucleotides also may be introduced into a cell containing the target nucleotide sequence by formation of a conjugate with a ligand binding molecule, as described in WO 91/04753. Suitable ligand binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell.

Alternatively, a sense or an antisense oligonucleotide may be introduced into a cell containing the target nucleic acid sequence by formation of an oligonucleotide-lipid complex, as described in WO 90/10448. The sense or antisense oligonucleotide-lipid complex is preferably dissociated within the cell by an endogenous lipase.

Antisense or sense RNA or DNA molecules are generally at least about 5 bases in length, about 10 bases in length, about 15 bases in length, about 20 bases in length, about 25 bases in length, about 30 bases in length, about 35 bases in length, about 40 bases in length, about 45 bases in length, about 50 bases in length, about 55 bases in length, about 60 bases in length, about 65 bases in length, about 70 bases in length, about 75 bases in length, about 80 bases in length, about 85 bases in length, about 90 bases in length, about 95 bases in length, about 100 bases in length, or more.

The probes may also be employed in PCR techniques to generate a pool of sequences for identification of closely related PRO coding sequences.

Nucleotide sequences encoding a PRO can also be used to construct hybridization probes for mapping the gene which encodes that PRO and for the genetic analysis of individuals with genetic disorders. The nucleotide sequences provided herein may be mapped to a chromosome and specific regions of a chromosome using known techniques, such as in situ hybridization, linkage analysis against known chromosomal markers, and hybridization screening with libraries.

When the coding sequences for PRO encode a protein which binds to another protein (example, where the PRO is a receptor), the PRO can be used in assays to identify the other proteins or molecules involved in the binding interaction. By such methods, inhibitors of the receptor/ligand binding interaction can be identified. Proteins involved in such binding interactions can also be used to screen for peptide or small molecule inhibitors or agonists of the binding interaction. Also, the receptor PRO can be used to isolate correlative ligand(s). Screening assays can be designed to find lead compounds that mimic the biological activity of a native PRO or a receptor for PRO. Such screening assays will include assays amenable to high-throughput screening of chemical libraries, making them particularly suitable for identifying small molecule drug candidates. Small molecules contemplated include synthetic organic or inorganic compounds. The assays can be performed in a variety of formats, including protein-protein binding assays, biochemical screening assays, immunoassays and cell based assays, which are well characterized in the art.

Nucleic acids which encode PRO or its modified forms can also be used to generate either transgenic animals or "knock out" animals which, in turn, are useful in the development and screening of therapeutically useful reagents. A transgenic animal (e.g., a mouse or rat) is an animal having cells that contain a transgene, which transgene was introduced into the animal or an ancestor of the animal at a prenatal, e.g., an embryonic stage. A transgene is a DNA which is integrated into the genome of a cell from which a transgenic animal develops. In one embodiment, cDNA encoding PRO can be used to clone genomic DNA encoding PRO in accordance with established techniques and the genomic sequences used to generate transgenic animals that contain cells which express DNA encoding PRO. Methods for generating transgenic animals, particularly animals such as mice or rats, have become conventional in the art and are described, for example, in U.S. Pat. Nos. 4,736,866 and 4,870,009. Typically, particular cells would be targeted for PRO transgene incorporation with tissue-specific enhancers. Transgenic animals that include a copy of a transgene encoding PRO introduced into the germ line of the animal at an embryonic stage can be used to examine the effect of increased expression of DNA encoding PRO. Such animals can be used as tester animals for reagents thought to confer protection from, for example, pathological conditions associated with its overexpression. In accordance with this facet of the invention, an animal is treated with the reagent and a reduced incidence of the pathological condition, compared to untreated animals bearing the transgene, would indicate a potential therapeutic intervention for the pathological condition.

Alternatively, non-human homologues of PRO can be used to construct a PRO "knock out" animal which has a defective or altered gene encoding PRO as a result of homologous recombination between the endogenous gene encoding PRO and altered genomic DNA encoding PRO introduced into an embryonic stem cell of the animal. For example, cDNA encoding PRO can be used to clone genomic DNA encoding PRO in accordance with established techniques. A portion of the genomic DNA encoding PRO can be deleted or replaced with another gene, such as a gene encoding a selectable marker which can be used to monitor integration. Typically, several kilobases of unaltered flanking DNA (both at the 5' and 3' ends) are included in the vector [see e.g., Thomas and Capecchi, *Cell,* 51:503 (1987) for a description of homologous recombination vectors]. The vector is introduced into an embryonic stem cell line (e.g., by electroporation) and cells in which the introduced DNA has homologously recombined with the endogenous DNA are selected [see e.g., Li et al., *Cell,* 69:915 (1992)]. The selected cells are then injected into a blastocyst of an animal (e.g., a mouse or rat) to form aggregation chimeras [see e.g., Bradley, in *Teratocarcinomas and Embryonic Stem Cells: A Practical Approach,* E. J. Robertson, ed. (IRL, Oxford, 1987), pp. 113-152]. A chimeric embryo can then be implanted into a suitable pseudopregnant female foster animal and the embryo brought to term to create a "knock out" animal. Progeny harboring the homologously recombined DNA in their germ cells can be identified by standard techniques and used to breed animals in which all cells of the animal contain the homologously recombined DNA. Knockout animals can be characterized for instance, for their ability to defend against certain pathological conditions and for their development of pathological conditions due to absence of the PRO polypeptide.

Nucleic acid encoding the PRO polypeptides may also be used in gene therapy. In gene therapy applications, genes are introduced into cells in order to achieve in vivo synthesis of a therapeutically effective genetic product, for example for replacement of a defective gene. "Gene therapy" includes both conventional gene therapy where a lasting effect is achieved by a single treatment, and the administration of gene therapeutic agents, which involves the one time or repeated administration of a therapeutically effective DNA or mRNA. Antisense RNAs and DNAs can be used as therapeutic agents for blocking the expression of certain genes in vivo. It has already been shown that short antisense oligonucleotides can be imported into cells where they act as inhibitors, despite their low intracellular concentrations caused by their restricted uptake by the cell membrane. (Zamecnik et al., *Proc. Natl. Acad. Sci. USA* 83:4143-4146 [1986]). The oligonucleotides can be modified to enhance their uptake, e.g. by substituting their negatively charged phosphodiester groups by uncharged groups.

There are a variety of techniques available for introducing nucleic acids into viable cells. The techniques vary depending upon whether the nucleic acid is transferred into cultured cells in vitro, or in vivo in the cells of the intended host. Techniques suitable for the transfer of nucleic acid into mammalian cells in vitro include the use of liposomes, electroporation, microinjection, cell fusion, DEAE-dextran, the calcium phosphate precipitation method, etc. The currently preferred in vivo gene transfer techniques include transfection with viral (typically retroviral) vectors and viral coat protein-liposome mediated transfection (Dzau et al., *Trends in Biotechnology* 11, 205-210 [1993]). In some situations it is desirable to provide the nucleic acid source with an agent that targets the target cells, such as an antibody specific for a cell surface membrane protein or the target cell, a ligand for a receptor on the target cell, etc. Where liposomes are employed, proteins which bind to a cell surface membrane protein associated with endocytosis may be used for targeting and/or to facilitate uptake, e.g. capsid proteins or fragments thereof tropic for a particular cell type, antibodies for proteins which undergo internalization in cycling, proteins that target intracellular localization and enhance intracellular half-life. The technique of receptor-mediated endocytosis is described, for example, by Wu et al., *J. Biol. Chem.* 262, 4429-4432 (1987); and Wagner et al., *Proc. Natl. Acad. Sci. USA* 87, 3410-3414 (1990). For review of gene marking and gene therapy protocols see Anderson et al., *Science* 256, 808-813 (1992).

The PRO polypeptides described herein may also be employed as molecular weight markers for protein electrophoresis purposes and the isolated nucleic acid sequences may be used for recombinantly expressing those markers.

The nucleic acid molecules encoding the PRO polypeptides or fragments thereof described herein are useful for chromosome identification. In this regard, there exists an ongoing need to identify new chromosome markers, since relatively few chromosome marking reagents, based upon actual sequence data are presently available. Each PRO nucleic acid molecule of the present invention can be used as a chromosome marker.

The PRO polypeptides and nucleic acid molecules of the present invention may also be used diagnostically for tissue typing, wherein the PRO polypeptides of the present invention may be differentially expressed in one tissue as compared to another, preferably in a diseased tissue as compared to a normal tissue of the same tissue type. PRO nucleic acid molecules will find use for generating probes for PCR, Northern analysis, Southern analysis and Western analysis.

The PRO polypeptides described herein may also be employed as therapeutic agents. The PRO polypeptides of the present invention can be formulated according to known methods to prepare pharmaceutically useful compositions, whereby the PRO product hereof is combined in admixture with a pharmaceutically acceptable carrier vehicle. Therapeutic formulations are prepared for storage by mixing the active ingredient having the desired degree of purity with optional physiologically acceptable carriers, excipients or stabilizers (*Remington's Pharmaceutical Sciences* 16th edition, Osol, A. Ed. (1980)), in the form of lyophilized formulations or aqueous solutions. Acceptable carriers, excipients or stabilizers are nontoxic to recipients at the dosages and concentrations employed, and include buffers such as phosphate, citrate and other organic acids; antioxidants including ascorbic acid; low molecular weight (less than about 10 residues) polypeptides; proteins, such as serum albumin, gelatin or immunoglobulins; hydrophilic polymers such as polyvinylpyrrolidone, amino acids such as glycine, glutamine, asparagine, arginine or lysine; monosaccharides, disaccharides and other carbohydrates including glucose, mannose, ordextrins; chelating agents such as EDTA; sugar alcohols such as mannitol or sorbitol; salt-forming counterions such as sodium; and/or nonionic surfactants such as TWEEN™, PLURONICS™ or PEG.

The formulations to be used for in vivo administration must be sterile. This is readily accomplished by filtration through sterile filtration membranes, prior to or following lyophilization and reconstitution.

Therapeutic compositions herein generally are placed into a container having a sterile access port, for example, an intravenous solution bag or vial having a stopper pierceable by a hypodermic injection needle.

The route of administration is in accord with known methods, e.g. injection or infusion by intravenous, intraperitoneal, intracerebral, intramuscular, intraocular, intraarterial or intralesional routes, topical administration, or by sustained release systems.

Dosages and desired drug concentrations of pharmaceutical compositions of the present invention may vary depending on the particular use envisioned. The determination of the appropriate dosage or route of administration is well within the skill of an ordinary physician. Animal experiments provide reliable guidance for the determination of effective doses for human therapy. Interspecies scaling of effective doses can be performed following the principles laid down by Mordenti, J. and Chappell, W. "The use of interspecies scaling in toxicokinetics" In Toxicokinetics and New Drug Development, Yacobi et al., Eds., Pergamon Press, New York 1989, pp. 42-96.

When in vivo administration of a PRO polypeptide or agonist or antagonist thereof is employed, normal dosage amounts may vary from about 10 ng/kg to up to 100 mg/kg of mammal body weight or more per day, preferably about 1 µg/kg/day to 10 mg/kg/day, depending upon the route of administration. Guidance as to particular dosages and methods of delivery is provided in the literature; see, for example, U.S. Pat. Nos. 4,657,760; 5,206,344; or U.S. Pat. No. 5,225,212. It is anticipated that different formulations will be effective for different treatment compounds and different disorders, that administration targeting one organ or tissue, for example, may necessitate delivery in a manner different from that to another organ or tissue.

Where sustained-release administration of a PRO polypeptide is desired in a formulation with release characteristics suitable for the treatment of any disease or disorder requiring administration of the PRO polypeptide, microencapsulation of the PRO polypeptide is contemplated. Microencapsulation of recombinant proteins for sustained release has been successfully performed with human growth hormone (rhGH), interferon-(rhIFN-), interleukin-2, and MN rgp120. Johnson et al., *Nat. Med.*, 2:795-799 (1996); Yasuda, *Biomed. Ther.*, 27:1221-1223 (1993); Hora et al., *Bio/Technology*, 8:755-758 (1990); Cleland, "Design and Production of Single Immunization Vaccines Using Polylactide Polyglycolide Microsphere Systems," in *Vaccine Design: The Subunit and Adiuvant Approach*, Powell and Newman, eds, (Plenum Press: New York, 1995), pp. 439-462; WO 97/03692, WO 96/40072, WO 96/07399; and U.S. Pat. No. 5,654,010.

The sustained-release formulations of these proteins were developed using poly-lactic-coglycolic acid (PLGA) polymer due to its biocompatibility and wide range of biodegradable properties. The degradation products of PLGA, lactic and glycolic acids, can be cleared quickly within the human body. Moreover, the degradability of this polymer can be adjusted from months to years depending on its molecular weight and composition. Lewis, "Controlled release of bioactive agents from lactide/glycolide polymer," in: M. Chasin and R. Langer (Eds.), *Biodegradable Polymers as Drug Delivery Systems* (Marcel Dekker: New York, 1990), pp. 1-41.

This invention encompasses methods of screening compounds to identify those that mimic the PRO polypeptide (agonists) or prevent the effect of the PRO polypeptide (antagonists). Screening assays for antagonist drug candidates are designed to identify compounds that bind or complex with the PRO polypeptides encoded by the genes identified herein, or otherwise interfere with the interaction of the encoded polypeptides with other cellular proteins. Such screening assays will include assays amenable to high-throughput screening of chemical libraries, making them particularly suitable for identifying small molecule drug candidates.

The assays can be performed in a variety of formats, including protein-protein binding assays, biochemical screening assays, immunoassays, and cell-based assays, which are well characterized in the art.

All assays for antagonists are common in that they call for contacting the drug candidate with a PRO polypeptide encoded by a nucleic acid identified herein under conditions and for a time sufficient to allow these two components to interact.

In binding assays, the interaction is binding and the complex formed can be isolated or detected in the reaction mixture. In a particular embodiment, the PRO polypeptide encoded by the gene identified herein or the drug candidate is immobilized on a solid phase, e.g., on a microtiter plate, by covalent or non-covalent attachments. Non-covalent attachment generally is accomplished by coating the solid surface with a solution of the PRO polypeptide and drying. Alternatively, an immobilized antibody, e.g., a monoclonal antibody, specific for the PRO polypeptide to be immobilized can be used to anchor it to a solid surface. The assay is performed by adding the non-immobilized component, which may be labeled by a detectable label, to the immobilized component, e.g., the coated surface containing the anchored component. When the reaction is complete, the non-reacted components are removed, e.g., by washing, and complexes anchored on the solid surface are detected. When the originally non-immobilized component carries a detectable label, the detection of label immobilized on the surface indicates that complexing occurred. Where the originally non-immobilized component does not carry a label, complexing can be detected, for example, by using a labeled antibody specifically binding the immobilized complex.

If the candidate compound interacts with but does not bind to a particular PRO polypeptide encoded by a gene identified herein, its interaction with that polypeptide can be assayed by methods well known for detecting protein-protein interactions. Such assays include traditional approaches, such as, e.g., cross-linking, co-immunoprecipitation, and co-purification through gradients or chromatographic columns. In addition, protein-protein interactions can be monitored by using a yeast-based genetic system described by Fields and co-workers (Fields and Song, *Nature* (*London*), 340:245-246 (1989); Chien et al., *Proc. Natl. Acad. Sci. USA,* 88:9578-9582 (1991)) as disclosed by Chevray and Nathans, *Proc. Natl. Acad. Sci. USA,* 89: 5789-5793 (1991). Many transcriptional activators, such as yeast GAL4, consist of two physically discrete modular domains, one acting as the DNA-binding domain, the other one functioning as the transcription-activation domain. The yeast expression system described in the foregoing publications (generally referred to as the "two-hybrid system") takes advantage of this property, and employs two hybrid proteins, one in which the target protein is fused to the DNA-binding domain of GAL4, and another, in which candidate activating proteins are fused to the activation domain. The expression of a GAL 1-lacZ reporter gene under control of a GAL4-activated promoter depends on reconstitution of GALA activity via protein-protein interaction. Colonies containing interacting polypeptides are detected with a chromogenic substrate for β-galactosidase. A complete kit (MATCHMAKER™) for identifying protein-protein interactions between two specific proteins using the two-hybrid technique is commercially available from Clontech. This system can also be extended to map protein domains involved in specific protein interactions as well as to pinpoint amino acid residues that are crucial for these interactions.

Compounds that interfere with the interaction of a gene encoding a PRO polypeptide identified herein and other intra- or extracellular components can be tested as follows: usually a reaction mixture is prepared containing the product of the gene and the intra- or extracellular component under conditions and for a time allowing for the interaction and binding of the two products. To test the ability of a candidate compound to inhibit binding, the reaction is run in the absence and in the presence of the test compound. In addition, a placebo may be added to a third reaction mixture, to serve as positive control. The binding (complex formation) between the test compound and the intra- or extracellular component present in the mixture is monitored as described hereinabove. The formation of a complex in the control reaction(s) but not in the reaction mixture containing the test compound indicates that the test compound interferes with the interaction of the test compound and its reaction partner.

To assay for antagonists, the PRO polypeptide may be added to a cell along with the compound to be screened for a particular activity and the ability of the compound to inhibit the activity of interest in the presence of the PRO polypeptide indicates that the compound is an antagonist to the PRO polypeptide. Alternatively, antagonists may be detected by combining the PRO polypeptide and a potential antagonist with membrane-bound PRO polypeptide receptors or recombinant receptors under appropriate conditions for a competitive inhibition assay. The PRO polypeptide can be labeled, such as by radioactivity, such that the number of PRO polypeptide molecules bound to the receptor can be used to determine the effectiveness of the potential antagonist. The gene encoding the receptor can be identified by numerous methods known to those of skill in the art, for example, ligand panning and FACS sorting. Coligan et al., *Current Protocols in Immun.,* 1(2): Chapter 5 (1991). Preferably, expression cloning is employed wherein polyadenylated RNA is prepared from a cell responsive to the PRO polypeptide and a cDNA library created from this RNA is divided into pools and used to transfect COS cells or other cells that are not responsive to the PRO polypeptide. Transfected cells that are grown on glass slides are exposed to labeled PRO polypeptide. The PRO polypeptide can be labeled by a variety of means including iodination or inclusion of a recognition site for a site-specific protein kinase. Following fixation and incubation, the slides are subjected to autoradiographic analysis. Positive pools are identified and sub-pools are prepared and re-transfected using an interactive sub-pooling and re-screening process, eventually yielding a single clone that encodes the putative receptor.

As an alternative approach for receptor identification, labeled PRO polypeptide can be photoaffinity-linked with cell membrane or extract preparations that express the receptor molecule. Cross-linked material is resolved by PAGE and exposed to X-ray film. The labeled complex containing the receptor can be excised, resolved into peptide fragments, and subjected to protein micro-sequencing. The amino acid sequence obtained from micro-sequencing would be used to design a set of degenerate oligonucleotide probes to screen a cDNA library to identify the gene encoding the putative receptor.

In another assay for antagonists, mammalian cells or a membrane preparation expressing the receptor would be incubated with labeled PRO polypeptide in the presence of the candidate compound. The ability of the compound to enhance or block this interaction could then be measured.

More specific examples of potential antagonists include an oligonucleotide that binds to the fusions of immunoglobulin with PRO polypeptide, and, in particular, antibodies including, without limitation, poly- and monoclonal antibodies and antibody fragments, single-chain antibodies, anti-idiotypic antibodies, and chimeric or humanized versions of such antibodies or fragments, as well as human antibodies and antibody fragments. Alternatively, a potential antagonist may be a closely related protein, for example, a mutated form of the PRO polypeptide that recognizes the receptor but imparts no effect, thereby competitively inhibiting the action of the PRO polypeptide.

Another potential PRO polypeptide antagonist is an antisense RNA or DNA construct prepared using antisense technology, where, e.g., an antisense RNA or DNA molecule acts to block directly the translation of mRNA by hybridizing to targeted mRNA and preventing protein translation. Antisense technology can be used to control gene expression through triple-helix formation or antisense DNA or RNA, both of which methods are based on binding of a polynucleotide to DNA or RNA. For example, the 5' coding portion of the polynucleotide sequence, which encodes the mature PRO polypeptides herein, is used to design an antisense RNA oligonucleotide of from about 10 to 40 base pairs in length. A DNA oligonucleotide is designed to be complementary to a region of the gene involved in transcription (triple helix—see Lee et al., *Nucl. Acids Res.,* 6:3073 (1979); Cooney et al., *Science,* 241: 456 (1988); Dervan et al., *Science,* 251:1360 (1991)), thereby preventing transcription and the production of the PRO polypeptide. The antisense RNA oligonucleotide hybridizes to the mRNA in vivo and blocks translation of the mRNA molecule into the PRO polypeptide (antisense—Okano, *Neurochem.,* 56:560 (1991); *Oligodeoxynucleotides as Antisense Inhibitors of Gene Expression* (CRC Press: Boca Raton, Fla., 1988). The oligonucleotides described above can also be delivered to cells such that the antisense RNA or DNA may be expressed in vivo to inhibit production of the PRO polypeptide. When antisense DNA is used, oligodeoxyribonucleotides derived from the translation-initiation site, e.g., between about −10 and +10 positions of the target gene nucleotide sequence, are preferred.

Potential antagonists include small molecules that bind to the active site, the receptor binding site, or growth factor or other relevant binding site of the PRO polypeptide, thereby blocking the normal biological activity of the PRO polypeptide. Examples of small molecules include, but are not limited to, small peptides or peptide-like molecules, preferably soluble peptides, and synthetic non-peptidyl organic or inorganic compounds.

Ribozymes are enzymatic RNA molecules capable of catalyzing the specific cleavage of RNA. Ribozymes act by sequence-specific hybridization to the complementary target RNA, followed by endonucleolytic cleavage. Specific ribozyme cleavage sites within a potential RNA target can be identified by known techniques. For further details see, e.g., Rossi, *Current Biology,* 4:469-471 (1994), and PCT publication No. WO 97/33551 (published Sep. 18, 1997).

Nucleic acid molecules in triple-helix formation used to inhibit transcription should be single-stranded and composed of deoxynucleotides. The base composition of these oligonucleotides is designed such that it promotes triple-helix formation via Hoogsteen base-pairing rules, which generally require sizeable stretches of purines or pyrimidines on one strand of a duplex. For further details see, e.g., PCT publication No. WO 97/33551, supra.

These small molecules can be identified by any one or more of the screening assays discussed hereinabove and/or by any other screening techniques well known for those skilled in the art.

Diagnostic and therapeutic uses of the herein disclosed molecules may also be based upon the positive functional assay hits disclosed and described below.

F. Anti-PRO Antibodies

The present invention further provides anti-PRO antibodies. Exemplary antibodies include polyclonal, monoclonal, humanized, bispecific, and heteroconjugate antibodies.

1. Polyclonal Antibodies

The anti-PRO antibodies may comprise polyclonal antibodies. Methods of preparing polyclonal antibodies are known to the skilled artisan. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. The immunizing agent may include the PRO polypeptide or a fusion protein thereof. It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants which may be employed include Freund's complete adjuvant and MPL-TDM adjuvant (monophosphoryl Lipid A, synthetic trehalose dicorynomycolate). The immunization protocol may be selected by one skilled in the art without undue experimentation.

2. Monoclonal Antibodies

The anti-PRO antibodies may, alternatively, be monoclonal antibodies. Monoclonal antibodies may be prepared using hybridoma methods, such as those described by Kohler and Milstein, *Nature,* 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes may be immunized in vitro.

The immunizing agent will typically include the PRO polypeptide or a fusion protein thereof. Generally, either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, *Monoclonal Antibodies: Principles and Practice,* Academic Press, (1986) pp. 59-103]. Immortalized cell lines are usually transformed mammalian cells, particularly myeloma cells of rodent, bovine and human origin. Usually, rat or mouse myeloma cell lines are employed. The hybridoma cells may be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies [Kozbor, *J. Immunol.,*

133:3001 (1984); Brodeur et al., *Monoclonal Antibody Production Techniques and Applications,* Marcel Dekker, Inc., New York, (1987) pp. 51-63].

The culture medium in which the hybridoma cells are cultured can then be assayed for the presence of monoclonal antibodies directed against PRO. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.,* 107:220 (1980).

After the desired hybridoma cells are identified, the clones may be subcloned by limiting dilution procedures and grown by standard methods [Goding, supra]. Suitable culture media for this purpose include, for example, Dulbecco's Modified Eagle's Medium and RPMI-1640 medium. Alternatively, the hybridoma cells may be grown in vivo as ascites in a mammal.

The monoclonal antibodies secreted by the subclones may be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies may also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA may be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also may be modified, for example, by substituting the coding sequence for human heavy and light chain constant domains in place of the homologous murine sequences [U.S. Pat. No. 4,816,567; Morrison et al., supra] or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

The antibodies may be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain crosslinking. Alternatively, the relevant cysteine residues are substituted with another amino acid residue or are deleted so as to prevent crosslinking.

In vitro methods are also suitable for preparing monovalent antibodies. Digestion of antibodies to produce fragments thereof, particularly, Fab fragments, can be accomplished using routine techniques known in the art.

3. Human and Humanized Antibodies

The anti-PRO antibodies of the invention may further comprise humanized antibodies or human antibodies. Humanized forms of non-human (e.g., murine) antibodies are chimeric immunoglobulins, immunoglobulin chains or fragments thereof (such as Fv, Fab, Fab', $F(ab')_2$ or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., *Nature,* 321:522-525 (1986); Riechmann et al., *Nature* 332:323-329 (1988); and Presta, *Curr. Op. Struct. Biol.,* 2:593-596 (1992)].

Methods for humanizing non-human antibodies are well known in the art. Generally, a humanized antibody has one or more amino acid residues introduced into it from a source which is non-human. These non-human amino acid residues are often referred to as "import" residues, which are typically taken from an "import" variable domain. Humanization can be essentially performed following the method of Winter and co-workers [Jones et al., *Nature,* 321:522-525 (1986); Riechmann et al., *Nature,* 332:323-327 (1988); Verhoeyen et al., *Science,* 239:1534-1536 (1988)], by substituting rodent CDRs or CDR sequences for the corresponding sequences of a human antibody. Accordingly, such "humanized" antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, *J. Mol. Biol.,* 227:381 (1991); Marks et al., *J. Mol. Biol.,* 222:581 (1991)]. The techniques of Cole et al. and Boerner et al. are also available for the preparation of human monoclonal antibodies (Cole et al., *Monoclonal Antibodies and Cancer Therapy,* Alan R. Liss, p. 77 (1985) and Boerner et al., *J. Immunol.,* 147(1):86-95 (1991)]. Similarly, human antibodies can be made by introducing of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., *Bio/Technology* 10, 779-783 (1992); Lonberg et al., *Nature* 368 856-859 (1994); Morrison, *Nature* 368, 812-13 (1994); Fishwild et al., *Nature Biotechnology* 14, 845-51 (1996);

Neuberger, *Nature Biotechnology* 14, 826 (1996); Lonberg and Huszar, *Intern. Rev. Immunol.* 13 65-93 (1995).

The antibodies may also be affinity matured using known selection and/or mutagenesis methods as described above. Preferred affinity matured antibodies have an affinity which is five times, more preferably 10 times, even more preferably 20 or 30 times greater than the starting antibody (generally murine, humanized or human) from which the matured antibody is prepared.

4. Bispecific Antibodies

Bispecific antibodies are monoclonal, preferably human or humanized, antibodies that have binding specificities for at least two different antigens. In the present case, one of the binding specificities is for the PRO, the other one is for any other antigen, and preferably for a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities [Milstein and Cuello, *Nature,* 305:537-539 (1983)]. Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published May 13, 1993, and in Traunecker et al., *EMBO J.,* 10:3655-3659 (1991).

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., *Methods in Enzymology,* 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. $F(ab')_2$ bispecific antibodies). Techniques for generating bispecific antibodies from antibody fragments have been described in the literature. For example, bispecific antibodies can be prepared can be prepared using chemical linkage. Brennan et al., *Science* 229:81 (1985) describe a procedure wherein intact antibodies are proteolytically cleaved to generate $F(ab')_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Fab' fragments may be directly recovered from *E. coli* and chemically coupled to form bispecific antibodies. Shalaby et al., *J. Exp. Med.* 175:217-225 (1992) describe the production of a fully humanized bispecific antibody $F(ab')_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various technique for making and isolating bispecific antibody fragments directly from recombinant cell culture have also been described. For example, bispecific antibodies have been produced using leucine zippers. Kostelny et al., *J. Immunol.* 148(5):1547-1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444-6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., *J. Immunol.* 152:5368 (1994).

Antibodies with more than two valencies are contemplated. For example, trispecific antibodies can be prepared. Tutt et al., *J. Immunol.* 147:60 (1991).

Exemplary bispecific antibodies may bind to two different epitopes on a given PRO polypeptide herein. Alternatively, an anti-PRO polypeptide arm may be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRIII (CD32) and FcγRII (CD16) so as to focus cellular defense mechanisms to the cell expressing the particular PRO polypeptide. Bispecific antibodies may also be used to localize cytotoxic agents to cells which express a particular PRO polypeptide. These antibodies possess a PRO-binding arm and an arm which binds a cytotoxic agent or a radionuclide chelator, such as EOTUBE, DPTA, DOTA, or TETA. Another bispecific antibody of interest binds the PRO polypeptide and further binds tissue factor (TF).

5. Heteroconiugate Antibodies

Heteroconjugate antibodies are also within the scope of the present invention. Heteroconjugate antibodies are composed of two covalently joined antibodies. Such antibodies have, for example, been proposed to target immune system cells to unwanted cells [U.S. Pat. No. 4,676,980], and for treatment of HIV infection [WO 91/00360; WO 92/200373; EP 03089]. It is contemplated that the antibodies may be prepared in vitro using known methods in synthetic protein chemistry, including those involving crosslinking agents. For example, immunotoxins may be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

6. Effector Function Engineering

It may be desirable to modify the antibody of the invention with respect to effector function, so as to enhance, e.g., the effectiveness of the antibody in treating cancer. For example, cysteine residue(s) may be introduced into the Fc region, thereby allowing interchain disulfide bond formation in this region. The homodimeric antibody thus generated may have improved internalization capability and/or increased complement-mediated cell killing and antibody-dependent cellular cytotoxicity (ADCC). See Caron et al., *J. Exp Med.,* 176: 1191-1195 (1992) and Shopes, *J. Immunol.,* 148: 2918-2922 (1992). Homodimeric antibodies with enhanced anti-tumor activity may also be prepared using heterobifunctional cross-linkers as described in Wolff et al. *Cancer Research,* 53: 2560-2565 (1993). Alternatively, an antibody can be engineered that has dual Fc regions and may thereby have enhanced complement lysis and ADCC capabilities. See Stevenson et al., *Anti-Cancer Drug Design,* 3: 219-230 (1989).

7. Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}Bi$, $^{131}I$, $^{131}In$, $^{90}Y$, and $^{186}Re$. Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis(p-azidobenzoyl)hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., *Science,* 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody may be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is conjugated to a cytotoxic agent (e.g., a radionucleotide).

8. Immunoliposomes

The antibodies disclosed herein may also be formulated as immunoliposomes. Liposomes containing the antibody are prepared by methods known in the art, such as described in Epstein et al., *Proc. Natl. Acad. Sci. USA,* 82: 3688 (1985); Hwang et al., *Proc. Natl Acad. Sci. USA,* 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., *J. Biol. Chem.,* 257: 286-288 (1982) via a disulfide-interchange reaction. A chemotherapeutic agent (such as Doxorubicin) is optionally contained within the liposome. See Gabizon et al., *J. National Cancer Inst.,* 81(19):1484 (1989).

9. Pharmaceutical Compositions of Antibodies

Antibodies specifically binding a PRO polypeptide identified herein, as well as other molecules identified by the screening assays disclosed hereinbefore, can be administered for the treatment of various disorders in the form of pharmaceutical compositions.

If the PRO polypeptide is intracellular and whole antibodies are used as inhibitors, internalizing antibodies are preferred. However, lipofections or liposomes can also be used to deliver the antibody, or an antibody fragment, into cells. Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al., *Proc. Natl. Acad. Sci. USA,* 90: 7889-7893 (1993). The formulation herein may also contain more than one active compound as necessary for the particular indication being treated, preferably those with complementary activities that do not adversely affect each other. Alternatively, or in addition, the composition may comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles, and nanocapsules) or in macroemulsions. Such techniques are disclosed in Remington's *Pharmaceutical Sciences,* supra.

The formulations to be used for in vivo administration must be sterile. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulflhydryl residues, lyophilizing from acidic solutions, controlling moisture content, using appropriate additives, and developing specific polymer matrix compositions.

G. Uses for anti-PRO Antibodies

The anti-PRO antibodies of the invention have various utilities. For example, anti-PRO antibodies may be used in diagnostic assays for PRO, e.g., detecting its expression (and in some cases, differential expression) in specific cells, tissues, or serum. Various diagnostic assay techniques known in the art may be used, such as competitive binding assays, direct or indirect sandwich assays and immunoprecipitation assays conducted in either heterogeneous or homogeneous phases [Zola, *Monoclonal Antibodies: A Manual of Techniques,* CRC Press, Inc. (1987) pp. 147-158]. The antibodies used in the diagnostic assays can be labeled with a detectable moiety. The detectable moiety should be capable of producing, either directly or indirectly, a detectable signal. For example, the detectable moiety may be a radioisotope, such as $^{3}H$, $^{14}C$, $^{32}P$, $^{35}S$, or $^{25}I$, a fluorescent or chemiluminescent compound, such as fluorescein isothiocyanate, rhodamine, or luciferin, or an enzyme, such as alkaline phosphatase, beta-galactosidase or horseradish peroxidase. Any method known in the art for conjugating the antibody to the detectable moiety may be employed, including those methods described by Hunter et al., *Nature,* 144:945 (1962); David et al., *Biochemistry,* 13:1014 (1974); Pain et al., *J. Immunol. Meth.,* 40:219 (1981); and Nygren, *J. Histochem. and Cytochem.,* 30:407 (1982).

Anti-PRO antibodies also are useful for the affinity purification of PRO from recombinant cell culture or natural sources. In this process, the antibodies against PRO are immobilized on a suitable support, such a Sephadex resin or filter paper, using methods well known in the art. The immobilized antibody then is contacted with a sample containing the PRO to be purified, and thereafter the support is washed with a suitable solvent that will remove substantially all the material in the sample except the PRO, which is bound to the immobilized antibody. Finally, the support is washed with another suitable solvent that will release the PRO from the antibody.

The following examples are offered for illustrative purposes only, and are not intended to limit the scope of the present invention in any way.

All patent and literature references cited in the present specification are hereby incorporated by reference in their entirety.

EXAMPLES

Commercially available reagents referred to in the examples were used according to manufacturer's instructions unless otherwise indicated. The source of those cells identified in the following examples, and throughout the specification, by ATCC accession numbers is the American Type Culture Collection, Manassas, Va.

Example 1

Extracellular Domain Homology Screening to Identify Novel Polypeptides and cDNA Encoding Therefor The extracellular domain (ECD) sequences (including the secretion signal sequence, if any) from about 950 known secreted proteins from the Swiss-Prot public database were used to search EST databases. The EST databases included public databases (e.g., Dayhoff, GenBank), and proprietary databases (e.g. LIFESEQ™, Incyte Pharmaceuticals, Palo Alto, Calif.). The search was performed using the computer program BLAST or BLAST-2 (Altschul et al., *Methods in Enzymology,* 266:460-480 (1996)) as a comparison of the ECD protein sequences to a 6 frame translation of the EST sequences. Those comparisons with a BLAST score of 70 (or in some cases 90) or greater that did not encode known proteins were clustered and assembled into consensus DNA sequences with the program "phrap" (Phil Green, University of Washington, Seattle, Wash.).

Using this extracellular domain homology screen, consensus DNA sequences were assembled relative to the other identified EST sequences using phrap. In addition, the consensus DNA sequences obtained were often (but not always) extended using repeated cycles of BLAST or BLAST-2 and phrap to extend the consensus sequence as far as possible using the sources of EST sequences discussed above.

Based upon the consensus sequences obtained as described above, oligonucleotides were then synthesized and used to identify by PCR a cDNA library that contained the sequence of interest and for use as probes to isolate a clone of the full-length coding sequence for a PRO polypeptide. Forward and reverse PCR primers generally range from 20 to 30 nucleotides and are often designed to give a PCR product of about 100-1000 bp in length. The probe sequences are typically 40-55 bp in length. In some cases, additional oligonucleotides are synthesized when the consensus sequence is greater than about 1-1.5 kbp. In order to screen several libraries for a full-length clone, DNA from the libraries was screened by PCR amplification, as per Ausubel et al., *Current Protocols in Molecular Biology,* with the PCR primer pair. A positive library was then used to isolate clones encoding the gene of interest using the probe oligonucleotide and one of the primer pairs.

The cDNA libraries used to isolate the cDNA clones were constructed by standard methods using commercially available reagents such as those from Invitrogen, San Diego, Calif. The cDNA was primed with oligo dT containing a Noti site, linked with blunt to SalI hemikinased adaptors, cleaved with Noti, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science,* 253:1278-1280 (1991)) in the unique XhoI and Noti sites.

Example 2

Isolation of cDNA clones by Amylase Screening

1. Preparation of Oligo dT Primed cDNA Library mRNA was isolated from a human tissue of interest using reagents and protocols from Invitrogen, San Diego, Calif. (Fast Track 2). This RNA was used to generate an oligo dT primed cDNA library in the vector pRK5D using reagents and protocols from Life Technologies, Gaithersburg, Md. (Super Script Plasmid System). In this procedure, the double stranded cDNA was sized to greater than 1000 bp and the SalI/NotI linkered cDNA was cloned into XhoI/NotI cleaved vector. pRK5D is a cloning vector that has an sp6 transcription initiation site followed by an SfiI restriction enzyme site preceding the XhoI/NotI cDNA cloning sites.

2. Preparation of Random Primed cDNA Library

A secondary cDNA library was generated in order to preferentially represent the 5' ends of the primary cDNA clones. Sp6 RNA was generated from the primary library (described above), and this RNA was used to generate a random primed cDNA library in the vector pSST-AMY.0 using reagents and protocols from Life Technologies (Super Script Plasmid System, referenced above). In this procedure the double stranded cDNA was sized to 500-1000 bp, linkered with blunt to NotI adaptors, cleaved with SfiI, and cloned into SfiI/NotI cleaved vector. pSST-AMY.0 is a cloning vector that has a yeast alcohol dehydrogenase promoter preceding the cDNA cloning sites and the mouse amylase sequence (the mature sequence without the secretion signal) followed by the yeast alcohol dehydrogenase terminator, after the cloning sites. Thus, cDNAs cloned into this vector that are fused in frame with amylase sequence will lead to the secretion of amylase from appropriately transfected yeast colonies.

3. Transformation and Detection

DNA from the library described in paragraph 2 above was chilled on ice to which was added electrocompetent DHIOB bacteria (Life Technologies, 20 ml). The bacteria and vector mixture was then electroporated as recommended by the manufacturer. Subsequently, SOC media (Life Technologies, 1 ml) was added and the mixture was incubated at 37° C. for 30 minutes. The transformants were then plated onto 20 standard 150 mm LB plates containing ampicillin and incubated for 16 hours (37° C.). Positive colonies were scraped off the plates and the DNA was isolated from the bacterial pellet using standard protocols, e.g. CsCl-gradient. The purified DNA was then carried on to the yeast protocols below.

The yeast methods were divided into three categories: (1) Transformation of yeast with the plasmid/cDNA combined vector; (2) Detection and isolation of yeast clones secreting amylase; and (3) PCR amplification of the insert directly from the yeast colony and purification of the DNA for sequencing and further analysis.

The yeast strain used was HD56-5A (ATCC-90785). This strain has the following genotype: MAT alpha, ura3-52, leu2-3, leu2-112, his3-11, his3-15, $MAL^+$, $SUC^+$, $GAL^+$. Preferably, yeast mutants can be employed that have deficient post-translational pathways. Such mutants may have translocation deficient alleles in sec71, sec72, sec62, with truncated sec71 being most preferred. Alternatively, antagonists (including antisense nucleotides and/or ligands) which interfere with the normal operation of these genes, other proteins implicated in this post translation pathway (e.g., SEC61p, SEC72p, SEC62p, SEC63p, TDJ1p or SSA1p-4p) or the complex formation of these proteins may also be preferably employed in combination with the amylase-expressing yeast.

Transformation was performed based on the protocol outlined by Gietz et al., *Nucl. Acid. Res.,* 20:1425 (1992). Transformed cells were then inoculated from agar into YEPD complex media broth (100 ml) and grown overnight at 30° C. The YEPD broth was prepared as described in Kaiser et al., *Methods in Yeast Genetics,* Cold Spring Harbor Press, Cold Spring Harbor, N.Y., p. 207 (1994). The overnight culture was then diluted to about $2\times10^6$ cells/ml (approx. $OD_{600}$=0.1) into fresh YEPD broth (500 ml) and regrown to $1\times10^7$ cells/ml (approx. $OD_{600}$=4-0.5).

The cells were then harvested and prepared for transformation by transfer into GS3 rotor bottles in a Sorval GS3 rotor at 5,000 rpm for 5 minutes, the supernatant discarded, and then resuspended into sterile water, and centrifuged again in 50 ml falcon tubes at 3,500 rpm in a Beckman GS-6KR centrifuge. The supernatant was discarded and the cells were subsequently washed with LiAc/TE (10 ml, 10 mM Tris-HCl, 1 mM EDTA pH 7.5, 100 mM $Li_2OOCCH_3$), and resuspended into LiAc/TE (2.5 ml).

Transformation took place by mixing the prepared cells (100 μl) with freshly denatured single stranded salmon testes DNA (Lofstrand Labs, Gaithersburg, Md.) and transforming DNA (1 μg, vol.<10 μl) in microfuge tubes. The mixture was mixed briefly by vortexing, then 40% PEG/TE (600 μl, 40% polyethylene glycol-4000, 10 mM Tris-HCl, 1 mM EDTA, 100 mM $Li_2OOCCH_3$, pH 7.5) was added. This mixture was gently mixed and incubated at 30° C. while agitating for 30 minutes. The cells were then heat shocked at 42° C. for 15 minutes, and the reaction vessel centrifuged in a microfuge at 12,000 rpm for 5-10 seconds, decanted and resuspended into TE (500 μl, 10 mM Tris-HCl, 1 mM EDTA pH 7.5) followed by recentrifugation. The cells were then diluted into TE (1 ml) and aliquots (200 μl) were spread onto the selective media previously prepared in 150 mm growth plates (VWR).

Alternatively, instead of multiple small reactions, the transformation was performed using a single, large scale reaction, wherein reagent amounts were scaled up accordingly.

The selective media used was a synthetic complete dextrose agar lacking uracil (SCD-Ura) prepared as described in Kaiser et al., *Methods in Yeast Genetics,* Cold Spring Harbor Press, Cold Spring Harbor, N.Y., p. 208-210 (1994). Transformants were grown at 30° C. for 2-3 days.

The detection of colonies secreting amylase was performed by including red starch in the selective growth media. Starch was coupled to the red dye (Reactive Red-120, Sigma) as per the procedure described by Biely et al., *Anal. Biochem.,* 172:176-179 (1988). The coupled starch was incorporated into the SCD-Ura agar plates at a final concentration of 0.15% (w/v), and was buffered with potassium phosphate to a pH of 7.0 (50-100 mM final concentration).

The positive colonies were picked and streaked across fresh selective media (onto 150 mm plates) in order to obtain well isolated and identifiable single colonies. Well isolated single colonies positive for amylase secretion were detected by direct incorporation of red starch into buffered SCD-Ura agar. Positive colonies were determined by their ability to break down starch resulting in a clear halo around the positive colony visualized directly.

4. Isolation of DNA by PCR Amplification

When a positive colony was isolated, a portion of it was picked by a toothpick and diluted into sterile water (30 μl) in a 96 well plate. At this time, the positive colonies were either frozen and stored for subsequent analysis or immediately amplified. An aliquot of cells (5 μl) was used as a template for the PCR reaction in a 25 μl volume containing: 0.5 μl Klentaq (Clontech, Palo Alto, Calif.); 4.0 µl 10 mM dNTP's (Perkin Elmer-Cetus); 2.5 µl Kentaq buffer (Clontech); 0.25 µl forward oligo 1; 0.25 µl reverse oligo 2; 12.5 µl distilled water. The sequence of the forward oligonucleotide 1 was:

5'-TGTAAAACGACGGCCAGT <u>TAAATAGACCTGCAATTATTAATCT</u>-3' (SEQ ID NO:611)

The sequence of reverse oligonucleotide 2 was:

5'-CAGGAAACAGCTATGACC <u>ACCTGCACACCTGCAAATCCATT</u>-3' (SEQ ID NO:612)

PCR was then performed as follows:

| a. | | Denature | 92° C., 5 minutes |
|---|---|---|---|
| b. | 3 cycles of: | Denature | 92° C., 30 seconds |
| | | Anneal | 59° C., 30 seconds |
| | | Extend | 72° C., 60 seconds |
| c. | 3 cycles of: | Denature | 92° C., 30 seconds |
| | | Anneal | 57° C., 30 seconds |
| | | Extend | 72° C., 60 seconds |
| d. | 25 cycles of: | Denature | 92° C., 30 seconds |
| | | Anneal | 55° C., 30 seconds |
| | | Extend | 72° C., 60 seconds |
| e. | | Hold | 4° C. |

The underlined regions of the oligonucleotides annealed to the ADH promoter region and the amylase region, respectively, and amplified a 307 bp region from vector pSST-AMY.0 when no insert was present. Typically, the first 18 nucleotides of the 5' end of these oligonucleotides contained annealing sites for the sequencing primers. Thus, the total product of the PCR reaction from an empty vector was 343 bp. However, signal sequence-fused cDNA resulted in considerably longer nucleotide sequences.

Following the PCR, an aliquot of the reaction (5 µl) was examined by agarose gel electrophoresis in a 1% agarose gel using a Tris-Borate-EDTA (TBE) buffering system as described by Sambrook et al., supra. Clones resulting in a single strong PCR product larger than 400 bp were further analyzed by DNA sequencing after purification with a 96 Qiaquick PCR clean-up column (Qiagen Inc., Chatsworth, Calif.).

Example 3

Isolation of cDNA Clones Using Signal Algorithm Analysis

Various polypeptide-encoding nucleic acid sequences were identified by applying a proprietary signal sequence finding algorithm developed by Genentech, Inc. (South San Francisco, Calif.) upon ESTs as well as clustered and assembled EST fragments from public (e.g., GenBank) and/or private (LIFESEQ®, Incyte Pharmaceuticals, Inc., Palo Alto, Calif.) databases. The signal sequence algorithm computes a secretion signal score based on the character of the DNA nucleotides surrounding the first and optionally the second methionine codon(s) (ATG) at the 5'-end of the sequence or sequence fragment under consideration. The nucleotides following the first ATG must code for at least 35 unambiguous amino acids without any stop codons. If the first ATG has the required amino acids, the second is not examined. If neither meets the requirement, the candidate sequence is not scored. In order to determine whether the EST sequence contains an authentic signal sequence, the DNA and corresponding amino acid sequences surrounding the ATG codon are scored using a set of seven sensors (evaluation parameters) known to be associated with secretion signals. Use of this algorithm resulted in the identification of numerous polypeptide-encoding nucleic acid sequences.

Example 4

Isolation of cDNA Clones Encoding Human PRO Polypeptides

Using the techniques described in Examples 1 to 3 above, numerous full-length cDNA clones were identified as encoding PRO polypeptides as disclosed herein. These cDNAs were then deposited under the terms of the Budapest Treaty with the American Type Culture Collection, 10801 University Blvd., Manassas, Va. 20110-2209, USA (ATCC) as shown in Table 7 below.

TABLE 7

| Material | ATCC Dep. No. | Deposit Date |
|---|---|---|
| DNA16435-1208 | 209930 | Jun. 2, 1998 |
| DNA23318-1211 | 209787 | Apr. 21, 1998 |
| DNA23322-1393 | 203400 | Oct. 27, 1998 |
| DNA23334-1392 | 209918 | Jun. 2, 1998 |
| DNA26843-1389 | 203099 | Aug. 4, 1998 |
| DNA26844-1394 | 209926 | Jun. 2, 1998 |
| DNA30867-1335 | 209807 | Apr. 28, 1998 |
| DNA33470-1175 | 209398 | Oct. 17, 1997 |
| DNA34436-1238 | 209523 | Dec. 10, 1997 |
| DNA35557-1137 | 209255 | Sep. 16, 1997 |
| DNA35599-1168 | 209373 | Oct. 16, 1997 |
| DNA35668-1171 | 209371 | Oct. 16, 1997 |
| DNA36992-1168 | 209382 | Oct. 16, 1997 |
| DNA39423-1182 | 209387 | Oct. 17, 1997 |
| DNA39427-1179 | 209395 | Oct. 17, 1997 |
| DNA39510-1181 | 209392 | Oct. 17, 1997 |
| DNA39518-1247 | 209529 | Dec. 10, 1997 |
| DNA39975-1210 | 209783 | Apr. 21, 1998 |
| DNA39976-1215 | 209524 | Dec. 10, 1997 |
| DNA39979-1213 | 209789 | Apr. 21, 1998 |
| DNA40594-1233 | 209617 | Feb. 5, 1998 |
| DNA40603-1232 | 209486 | Nov. 21, 1997 |
| DNA40604-1187 | 209394 | Oct. 17, 1997 |
| DNA40625-1189 | 209788 | Apr. 21, 1998 |
| DNA41225-1217 | 209491 | Nov. 21, 1997 |
| DNA41379-1236 | 209488 | Nov. 21, 1997 |
| DNA41386-1316 | 209703 | Mar. 26, 1998 |
| DNA44161-1434 | 209907 | May 27, 1998 |
| DNA44179-1362 | 209851 | May 6, 1998 |
| DNA44192-1246 | 209531 | Dec. 10, 1997 |
| DNA44694-1500 | 203114 | Aug. 11, 1998 |
| DNA45234-1277 | 209654 | Mar. 5, 1998 |
| DNA45409-2511 | 203579 | Jan. 12, 1999 |
| DNA45415-1318 | 209810 | Apr. 28, 1998 |
| DNA45417-1432 | 209910 | May 27, 1998 |
| DNA45493-1349 | 209805 | Apr. 28, 1998 |
| DNA46776-1284 | 209721 | Mar. 31, 1998 |
| DNA48296-1292 | 209668 | Mar. 11, 1998 |
| DNA48306-1291 | 209911 | May 27, 1998 |
| DNA48328-1355 | 209843 | May 6, 1998 |
| DNA48329-1290 | 209785 | Apr. 21, 1998 |
| DNA48334-1435 | 209924 | Jun. 2, 1998 |
| DNA49141-1431 | 203003 | Jun. 23, 1998 |
| DNA49624-1279 | 209655 | Mar. 5, 1998 |
| DNA49647-1398 | 209919 | Jun. 2, 1998 |
| DNA49819-1439 | 209931 | Jun. 2, 1998 |
| DNA50911-1288 | 209714 | Mar. 31, 1998 |
| DNA50914-1289 | 209722 | Mar. 31, 1998 |
| DNA50919-1361 | 209848 | May 6, 1998 |
| DNA50980-1286 | 209717 | Mar. 31, 1998 |
| DNA52185-1370 | 209861 | May 14, 1998 |
| DNA53906-1368 | 209747 | Apr. 7, 1998 |
| DNA53912-1457 | 209870 | May 14, 1998 |
| DNA53913-1490 | 203162 | Aug. 25, 1998 |
| DNA53977-1371 | 209862 | May 14, 1998 |
| DNA53978-1443 | 209983 | Jun. 16, 1998 |
| DNA53996-1442 | 209921 | Jun. 2, 1998 |

TABLE 7-continued

| Material | ATCC Dep. No. | Deposit Date |
|---|---|---|
| DNA54002-1367 | 209754 | Apr. 7, 1998 |
| DNA55737-1345 | 209753 | Apr. 7, 1998 |
| DNA56050-1455 | 203011 | Jun. 23, 1998 |
| DNA56052-1454 | 203026 | Jun. 23, 1998 |
| DNA56107-1415 | 203405 | Oct. 27, 1998 |
| DNA56110-1437 | 203113 | Aug. 11, 1998 |
| DNA56406-1704 | 203478 | Nov. 17, 1998 |
| DNA56409-1377 | 209882 | May 20, 1998 |
| DNA56410-1414 | 209923 | Jun. 2, 1998 |
| DNA56436-1448 | 209902 | May 27, 1998 |
| DNA56529-1647 | 203293 | Sep. 29, 1998 |
| DNA56855-1447 | 203004 | Jun. 23, 1998 |
| DNA56859-1445 | 203019 | Jun. 23, 1998 |
| DNA56860-1510 | 209952 | Jun. 9, 1998 |
| DNA56865-1491 | 203022 | Jun. 23, 1998 |
| DNA56868-1478 | 203024 | Jun. 23, 1998 |
| DNA56869-1545 | 203161 | Aug. 25, 1998 |
| DNA56870-1492 | 209925 | Jun. 2, 1998 |
| DNA57039-1402 | 209777 | Apr. 14, 1998 |
| DNA57253-1382 | 209867 | May 14, 1998 |
| DNA57254-1477 | 203289 | Sep. 29, 1998 |
| DNA57699-1412 | 203020 | Jun. 23, 1998 |
| DNA57704-1452 | 209953 | Jun. 9, 1998 |
| DNA57710-1451 | 203048 | Jul. 1, 1998 |
| DNA57827-1493 | 203045 | Jul. 1, 1998 |
| DNA57844-1410 | 203010 | Jun. 23, 1998 |
| DNA58723-1588 | 203133 | Aug. 18, 1998 |
| DNA58727-1474 | 203171 | Sep. 1, 1998 |
| DNA58730-1607 | 203221 | Sep. 15, 1998 |
| DNA58732-1650 | 203290 | Sep. 29, 1998 |
| DNA58737-1473 | 203136 | Aug. 18, 1998 |
| DNA58743-1609 | 203154 | Aug. 25, 1998 |
| DNA58747-1384 | 209868 | May 14, 1998 |
| DNA58828-1519 | 203172 | Sep. 1, 1998 |
| DNA58846-1409 | 209957 | Jun. 9, 1998 |
| DNA58848-1472 | 209955 | Jun. 9, 1998 |
| DNA58849-1494 | 209958 | Jun. 9, 1998 |
| DNA58850-1495 | 209956 | Jun. 9, 1998 |
| DNA58852-1637 | 203271 | Sep. 22, 1998 |
| DNA58853-1423 | 203016 | Jun. 23, 1998 |
| DNA58855-1422 | 203018 | Jun. 23, 1998 |
| DNA59211-1450 | 209960 | Jun. 9, 1998 |
| DNA59212-1627 | 203245 | Sep. 9, 1998 |
| DNA59213-1487 | 209959 | Jun. 9, 1998 |
| DNA59219-1613 | 203220 | Sep. 15, 1998 |
| DNA59497-1496 | 209941 | Jun. 4, 1998 |
| DNA59602-1436 | 203051 | Jul. 1, 1998 |
| DNA59603-1419 | 209944 | Jun. 9, 1998 |
| DNA59605-1418 | 203005 | Jun. 23, 1998 |
| DNA59607-1497 | 209946 | Jun. 9, 1998 |
| DNA59610-1556 | 209990 | Jun. 16, 1998 |
| DNA59612-1466 | 209947 | Jun. 9, 1998 |
| DNA59613-1417 | 203007 | Jun. 23, 1998 |
| DNA59616-1465 | 209991 | Jun. 16, 1998 |
| DNA59619-1464 | 203041 | Jul. 1, 1998 |
| DNA59625-1498 | 209992 | Jun. 16, 1998 |
| DNA59817-1703 | 203470 | Nov. 17, 1998 |
| DNA59827-1426 | 203089 | Aug. 4, 1998 |
| DNA59828-1608 | 203158 | Aug. 25, 1998 |
| DNA59837-2545 | 203658 | Feb. 9, 1999 |
| DNA59844-2542 | 203650 | Feb. 9, 1999 |
| DNA59853-1505 | 209985 | Jun. 16, 1998 |
| DNA59854-1459 | 209974 | Jun. 16, 1998 |
| DNA59855-1485 | 209987 | Jun. 16, 1998 |
| DNA60278-1530 | 203170 | Sep. 1, 1998 |
| DNA60283-1484 | 203043 | Jul. 1, 1998 |
| DNA60608-1577 | 203126 | Aug. 18, 1998 |
| DNA60611-1524 | 203175 | Sep. 1, 1998 |
| DNA60619-1482 | 209993 | Jun. 16, 1998 |
| DNA60625-1507 | 209975 | Jun. 16, 1998 |
| DNA60629-1481 | 209979 | Jun. 16, 1998 |
| DNA60740-1615 | 203456 | Nov. 3, 1998 |
| DNA61608-1606 | 203239 | Sep. 9, 1998 |
| DNA61755-1554 | 203112 | Aug. 11, 1998 |
| DNA62809-1531 | 203237 | Sep. 9, 1998 |
| DNA62812-1594 | 203248 | Sep. 9, 1998 |
| DNA62813-2544 | 203655 | Feb. 9, 1999 |

TABLE 7-continued

| Material | ATCC Dep. No. | Deposit Date |
|---|---|---|
| DNA62845-1684 | 203361 | Oct. 20, 1998 |
| DNA64849-1604 | 203468 | Nov. 17, 1998 |
| DNA64852-1589 | 203127 | Aug. 18, 1998 |
| DNA64863-1573 | 203251 | Sep. 9, 1998 |
| DNA64881-1602 | 203240 | Sep. 9, 1998 |
| DNA64902-1667 | 203317 | Oct. 6, 1998 |
| DNA64952-1568 | 203222 | Sep. 15, 1998 |
| DNA65403-1565 | 203230 | Sep. 15, 1998 |
| DNA65413-1534 | 203234 | Sep. 15, 1998 |
| DNA65423-1595 | 203227 | Sep. 15, 1998 |
| DNA66304-1546 | 203321 | Oct. 6, 1998 |
| DNA66308-1537 | 203159 | Aug. 25, 1998 |
| DNA66511-1563 | 203228 | Sep. 15, 1998 |
| DNA66512-1564 | 203218 | Sep. 15, 1998 |
| DNA66519-1535 | 203236 | Sep. 15, 1998 |
| DNA66521-1583 | 203225 | Sep. 15, 1998 |
| DNA66658-1584 | 203229 | Sep. 15, 1998 |
| DNA66660-1585 | 203279 | Sep. 22, 1998 |
| DNA66669-1597 | 203272 | Sep. 22, 1998 |
| DNA66674-1599 | 203281 | Sep. 22, 1998 |
| DNA68836-1656 | 203455 | Nov. 3, 1998 |
| DNA68862-2546 | 203652 | Feb. 9, 1999 |
| DNA68866-1644 | 203283 | Sep. 22, 1998 |
| DNA68869-1610 | 203164 | Aug. 25, 1998 |
| DNA68871-1638 | 203280 | Sep. 22, 1998 |
| DNA68879-1631 | 203274 | Sep. 22, 1998 |
| DNA68880-1676 | 203319 | Oct. 6, 1998 |
| DNA68882-1677 | 203318 | Oct. 6, 1998 |
| DNA68883-1691 | 203535 | Dec. 15, 1998 |
| DNA68885-1678 | 203311 | Oct. 6, 1998 |
| DNA71180-1655 | 203403 | Oct. 27, 1998 |
| DNA71184-1634 | 203266 | Sep. 22, 1998 |
| DNA71213-1659 | 203401 | Oct. 27, 1998 |
| DNA71234-1651 | 203402 | Oct. 27, 1998 |
| DNA71269-1621 | 203284 | Sep. 22, 1998 |
| DNA71277-1636 | 203285 | Sep. 22, 1998 |
| DNA71286-1687 | 203357 | Oct. 20, 1998 |
| DNA71883-1660 | 203475 | Nov. 17, 1998 |
| DNA73401-1633 | 203273 | Sep. 22, 1998 |
| DNA73492-1671 | 203324 | Oct. 6, 1998 |
| DNA73730-1679 | 203320 | Oct. 6, 1998 |
| DNA73734-1680 | 203363 | Oct. 20, 1998 |
| DNA73735-1681 | 203356 | Oct. 20, 1998 |
| DNA73742-1662 | 203316 | Oct. 6, 1998 |
| DNA73746-1654 | 203411 | Oct. 27, 1998 |
| DNA73760-1672 | 203314 | Oct. 6, 1998 |
| DNA76393-1664 | 203323 | Oct. 6, 1998 |
| DNA76398-1699 | 203474 | Nov. 17, 1998 |
| DNA76399-1700 | 203472 | Nov. 17, 1998 |
| DNA76522-2500 | 203469 | Nov. 17, 1998 |
| DNA76533-1689 | 203410 | Oct. 27, 1998 |
| DNA77303-2502 | 203479 | Nov. 17, 1998 |
| DNA77626-1705 | 203536 | Dec. 15, 1998 |
| DNA77648-1688 | 203408 | Oct. 27, 1998 |
| DNA81754-2532 | 203542 | Dec. 15, 1998 |
| DNA81757-2512 | 203543 | Dec. 15, 1998 |
| DNA82302-2529 | 203534 | Dec. 15, 1998 |
| DNA82340-2530 | 203547 | Dec. 22, 1998 |
| DNA87991-2540 | 203656 | Feb. 9, 1999 |
| DNA92238-2539 | 203602 | Jan. 20, 1999 |
| DNA115291-2681 | PTA-202 | Jun. 8, 1999 |
| DNA23336-2861 | PTA-1673 | Apr. 11, 2000 |
| DNA30862-1396 | 209920 | Jun. 2, 1998 |
| DNA30871-1157 | 209380 | Oct. 16, 1997 |
| DNA32279-1131 | 209259 | Sep. 16, 1997 |
| DNA33206-1165 | 209372 | Oct. 16, 1997 |
| DNA35673-1201 | 209418 | Oct. 28, 1997 |
| DNA47361-1154-2 | 209431 | Nov. 7, 1997 |
| DNA49631-1328 | 209806 | Apr. 28, 1998 |
| DNA52594-1270 | 209679 | Mar. 17, 1998 |
| DNA55800-1263 | 209680 | Mar. 17, 1998 |
| DNA56531-1648 | 203286 | Sep. 29, 1998 |
| DNA56965-1356 | 209842 | May 6, 1998 |
| DNA57037-1444 | 209903 | May 27, 1998 |
| DNA57695-1340 | 203006 | Jun. 23, 1998 |
| DNA57834-1339 | 209954 | Jun. 9, 1998 |
| DNA57841-1522 | 203458 | Nov. 3, 1998 |

TABLE 7-continued

| Material | ATCC Dep. No. | Deposit Date |
|---|---|---|
| DNA58847-1383 | 209879 | May 20, 1998 |
| DNA59493-1420 | 203050 | Jul. 1, 1998 |
| DNA59586-1520 | 203288 | Sep. 29, 1998 |
| DNA59608-2577 | 203870 | Mar. 23, 1999 |
| DNA59849-1504 | 209986 | Jun. 16, 1998 |
| DNA60292-1506 | 203540 | Dec. 15, 1998 |
| DNA62377-1381-1 | 203552 | Dec. 22, 1998 |
| DNA62880-1513 | 203097 | Aug. 4, 1998 |
| DNA66672-1586 | 203265 | Sep. 22, 1998 |
| DNA67962-1649 | 203291 | Sep. 29, 1998 |
| DNA69555-2867 | PTA-1632 | Apr. 4, 2000 |
| DNA71162-2764 | PTA-860 | Oct. 19, 1999 |
| DNA71290-1630 | 203275 | Sep. 22, 1998 |
| DNA76401-1683 | 203360 | Oct. 20, 1998 |
| DNA76541-1675 | 203409 | Oct. 27, 1998 |
| DNA76788-2526 | 203551 | Dec. 22, 1998 |
| DNA77623-2524 | 203546 | Dec. 22, 1998 |
| DNA80136-2503 | 203541 | Dec. 15, 1998 |
| DNA83568-2692 | PTA-386 | Jul. 20, 1999 |
| DNA84210-2576 | 203818 | Mar. 2, 1999 |
| DNA86576-2595 | 203868 | Mar. 23, 1999 |
| DNA87976-2593 | 203888 | Mar. 30, 1999 |
| DNA92256-2596 | 203891 | Mar. 30, 1999 |
| DNA92289-2598 | PTA-131 | May 25, 1999 |
| DNA96850-2705 | PTA-479 | Aug. 3, 1999 |
| DNA96855-2629 | PTA-18 | May 4, 1999 |
| DNA96857-2636 | PTA-17 | May 4, 1999 |
| DNA96860-2700 | PTA-478 | Aug. 3, 1999 |
| DNA96861-2844 | PTA-1436 | Mar. 2, 2000 |
| DNA96866-2698 | PTA-491 | Aug. 3, 1999 |
| DNA96870-2676 | PTA-254 | Jun. 22, 1999 |
| DNA96872-2674 | PTA-550 | Aug. 17, 1999 |
| DNA96878-2626 | PTA-23 | May 4, 1999 |
| DNA96879-2619 | 203967 | Apr. 27, 1999 |
| DNA96889-2641 | PTA-119 | May 25, 1999 |
| DNA96893-2621 | PTA-12 | May 4, 1999 |
| DNA96897-2688 | PTA-379 | Jul. 20, 1999 |
| DNA98564-2643 | PTA-125 | May 25, 1999 |
| DNA107443-2718 | PTA-490 | Aug. 3, 1999 |
| DNA107786-2723 | PTA-474 | Aug. 3, 1999 |
| DNA108682-2712 | PTA-486 | Aug. 3, 1999 |
| DNA108684-2761 | PTA-653 | Sep. 14, 1999 |
| DNA108701-2749 | PTA-554 | Aug. 17, 1999 |
| DNA108720-2717 | PTA-511 | Aug. 10, 1999 |
| DNA108726-2729 | PTA-514 | Aug. 10, 1999 |
| DNA108728-2760 | PTA-654 | Sep. 14, 1999 |
| DNA108738-2767 | PTA-862 | Oct. 19, 1999 |
| DNA108743-2722 | PTA-508 | Aug. 10, 1999 |
| DNA108758-2759 | PTA-655 | Sep. 14, 1999 |
| DNA108765-2758 | PTA-657 | Sep. 14, 1999 |
| DNA108783-2747 | PTA-616 | Aug. 31, 1999 |
| DNA108789-2748 | PTA-547 | Aug. 17, 1999 |
| DNA108806-2724 | PTA-610 | Aug. 31, 1999 |
| DNA108936-2719 | PTA-519 | Aug. 10, 1999 |
| DNA119510-2771 | PTA-947 | Nov. 9, 1999 |
| DNA119517-2778 | PTA-951 | Nov. 16, 1999 |
| DNA119535-2756 | PTA-613 | Aug. 31, 1999 |
| DNA119537-2777 | PTA-956 | Nov. 16, 1999 |
| DNA119714-2851 | PTA-1537 | Mar. 21, 2000 |
| DNA125170-2780 | PTA-953 | Nov. 16, 1999 |
| DNA129594-2841 | PTA-1481 | Mar. 14, 2000 |
| DNA129793-2857 | PTA-1733 | Apr. 18, 2000 |
| DNA130809-2769 | PTA-949 | Nov. 9, 1999 |
| DNA131639-2874 | PTA-1784 | Apr. 25, 2000 |
| DNA131649-2855 | PTA-1482 | Mar. 14, 2000 |
| DNA131652-2876 | PTA-1628 | Apr. 4, 2000 |
| DNA131658-2875 | PTA-1671 | Apr. 11, 2000 |
| DNA132162-2770 | PTA-950 | Nov. 9, 1999 |
| DNA136110-2763 | PTA-652 | Sep. 14, 1999 |
| DNA139592-2866 | PTA-1587 | Mar. 28, 2000 |
| DNA139608-2856 | PTA-1581 | Mar. 28, 2000 |
| DNA143292-2848 | PTA-1778 | Apr. 25, 2000 |
| DNA144844-2843 | PTA-1536 | Mar. 21, 2000 |
| DNA144857-2845 | PTA-1589 | Mar. 28, 2000 |
| DNA145841-2868 | PTA-1678 | Apr. 11, 2000 |
| DNA148004-2882 | PTA-1779 | Apr. 25, 2000 |
| DNA149893-2873 | PTA-1672 | Apr. 11, 2000 |

TABLE 7-continued

| Material | ATCC Dep. No. | Deposit Date |
|---|---|---|
| DNA149930-2884 | PTA-1668 | Apr. 11, 2000 |
| DNA150157-2898 | PTA-1777 | Apr. 25, 2000 |
| DNA150163-2842 | PTA-1533 | Mar. 21, 2000 |
| DNA153579-2894 | PTA-1729 | Apr. 18, 2000 |
| DNA164625-2890 | PTA-1535 | Mar. 21, 2000 |
| DNA57838-1337 | 203014 | Jun. 23, 1998 |
| DNA59777-1480 | 203111 | Aug. 11, 1998 |
| DNA66675-1587 | 203282 | Sep. 22, 1998 |
| DNA76532-1702 | 203473 | Nov. 17, 1998 |
| DNA105849-2704 | PTA-473 | Aug. 3, 1999 |
| DNA83500-2506 | 203391 | Oct. 29, 1998 |

These deposits were made under the provisions of the Budapest Treaty on the International Recognition of the Deposit of Microorganisms for the Purpose of Patent Procedure and the Regulations thereunder (Budapest Treaty). This assures maintenance of a viable culture of the deposit for 30 years from the date of deposit and for at least five (5) years after the most recent request for the furnishing of a sample of the deposit received by the depository. The deposits will be made available by ATCC under the terms of the Budapest Treaty, and subject to an agreement between Genentech, Inc. and ATCC, which assures that all restrictions imposed by the depositor on the availability to the public of the deposited material will be irrevocably removed upon the grantig of the pertinent U.S. patent, assures availability of the progeny of one determined by the U.S. Commissioner of Patents and Trademarks to be entitled thereto according to 35 USC § 122 and the Commissioner's rules pursuant thereto (including 37 CFR § 1.14 with particular reference to 886 OG 638).

The assignee of the present application has agreed that if a culture of the materials on deposit should die or be lost or destroyed when cultivated under suitable conditions, the materials will be promptly replaced on notification with another of the same. Availability of the deposited material is not to be construed as a license to practice the invention in contravention of the rights granted under the authority of any government in accordance with its patent laws.

Example 5

Use of PRO as a Hybridization Probe

The following method describes use of a nucleotide sequence encoding PRO as a hybridization probe.

DNA comprising the coding sequence of full-length or mature PRO as disclosed herein is employed as a probe to screen for homologous DNAs (such as those encoding naturally-occurring variants of PRO) in human tissue cDNA libraries or human tissue genomic libraries.

Hybridization and washing of filters containing either library DNAs is performed under the following high stringency conditions. Hybridization of radiolabeled PRO-derived probe to the filters is performed in a solution of 50% formamide, 5×SSC, 0.1% SDS, 0.1% sodium pyrophosphate, 50 mM sodium phosphate, pH 6.8, 2× Denhardt's solution, and 10% dextran sulfate at 42° C. for 20 hours. Washing of the filters is performed in an aqueous solution of 0.1×SSC and 0.1% SDS at 42° C.

DNAs having a desired sequence identity with the DNA encoding full-length native sequence PRO can then be identified using standard techniques known in the art.

Example 6

Expression of PRO in *E. coli*

This example illustrates preparation of an unglycosylated form of PRO by recombinant expression in *E. coli*.

The DNA sequence encoding PRO is initially amplified using selected PCR primers. The primers should contain restriction enzyme sites which correspond to the restriction enzyme sites on the selected expression vector. A variety of expression vectors may be employed. An example of a suitable vector is pBR322 (derived from *E. coli;* see Bolivar et al., *Gene,* 2:95 (1977)) which contains genes for ampicillin and tetracycline resistance. The vector is digested with restriction enzyme and dephosphorylated. The PCR amplified sequences are then ligated into the vector. The vector will preferably include sequences which encode for an antibiotic resistance gene, a trp promoter, a polyhis leader (including the first six STII codons, polyhis sequence, and enterokinase cleavage site), the PRO coding region, lambda transcriptional terminator, and an argU gene.

The ligation mixture is then used to transform a selected *E. coli* strain using the methods described in Sambrook et al., supra. Transformants are identified by their ability to grow on LB plates and antibiotic resistant colonies are then selected. Plasmid DNA can be isolated and confirmed by restriction analysis and DNA sequencing.

Selected clones can be grown overnight in liquid culture medium such as LB broth supplemented with antibiotics. The overnight culture may subsequently be used to inoculate a larger scale culture. The cells are then grown to a desired optical density, during which the expression promoter is turned on.

After culturing the cells for several more hours, the cells can be harvested by centrifugation. The cell pellet obtained by the centrifugation can be solubilized using various agents known in the art, and the solubilized PRO protein can then be purified using a metal chelating column under conditions that allow tight binding of the protein.

PRO may be expressed in *E. coli* in a poly-His tagged form, using the following procedure. The DNA encoding PRO is initially amplified using selected PCR primers. The primers will contain restriction enzyme sites which correspond to the restriction enzyme sites on the selected expression vector, and other useful sequences providing for efficient and reliable translation initiation, rapid purification on a metal chelation column, and proteolytic removal with enterokinase. The PCR-amplified, poly-His tagged sequences are then ligated into an expression vector, which is used to transform an *E. coli* host based on strain 52 (W3110 fuhA(tonA) Ion galE rpoHts(htpRts) clpP(lacIq). Transformants are first grown in LB containing 50 mg/ml carbenicillin at 30° C. with shaking until an O.D.600 of 3-5 is reached. Cultures are then diluted 50-100 fold into CRAP media (prepared by mixing 3.57 g $(NH_4)_2SO_4$, 0.71 g sodium citrate•2H2O, 1.07 g KCl, 5.36 g Difco yeast extract, 5.36 g Sheffield hycase SF in 500 mL water, as well as 110 mM MPOS, pH 7.3, 0.55% (w/v) glucose and 7 mM $MgSO_4$) and grown for approximately 20-30 hours at 30° C. with shaking. Samples are removed to verify expression by SDS-PAGE analysis, and the bulk culture is centrifuged to pellet the cells. Cell pellets are frozen until purification and refolding.

*E. coli* paste from 0.5 to 1 L fermentations (6-10 g pellets) is resuspended in 10 volumes (w/v) in 7 M guanidine, 20 mM Tris, pH 8 buffer. Solid sodium sulfite and sodium tetrathionate is added to make final concentrations of 0.1M and 0.02 M, respectively, and the solution is stirred overnight at 4° C. This step results in a denatured protein with all cysteine residues blocked by sulfitolization. The solution is centrifuged at 40,000 rpm in a Beckman Ultracentifuge for 30 min. The supernatant is diluted with 3-5 volumes of metal chelate column buffer (6 M guanidine, 20 mM Tris, pH 7.4) and filtered through 0.22 micron filters to clarify. The clarified extract is loaded onto a 5 ml Qiagen Ni-NTA metal chelate column equilibrated in the metal chelate column buffer. The column is washed with additional buffer containing 50 mM imidazole (Calbiochem, Utrol grade), pH 7.4. The protein is eluted with buffer containing 250 mM imidazole. Fractions containing the desired protein are pooled and stored at 4° C. Protein concentration is estimated by its absorbance at 280 nm using the calculated extinction coefficient based on its amino acid sequence.

The proteins are refolded by diluting the sample slowly into freshly prepared refolding buffer consisting of: 20 mM Tris, pH 8.6, 0.3 M NaCl, 2.5 M urea, 5 mM cysteine, 20 mM glycine and 1 mM EDTA. Refolding volumes are chosen so that the final protein concentration is between 50 to 100 micrograms/ml. The refolding solution is stirred gently at 4° C. for 12-36 hours. The refolding reaction is quenched by the addition of TFA to a final concentration of 0.4% (pH of approximately 3). Before further purification of the protein, the solution is filtered through a 0.22 micron filter and acetonitrile is added to 2-10% final concentration. The refolded protein is chromatographed on a Poros Ri/H reversed phase column using a mobile buffer of 0.1% TFA with elution with a gradient of acetonitrile from 10 to 80%. Aliquots of fractions with A280 absorbance are analyzed on SDS polyacrylamide gels and fractions containing homogeneous refolded protein are pooled. Generally, the properly refolded species of most proteins are eluted at the lowest concentrations of acetonitrile since those species are the most compact with their hydrophobic interiors shielded from interaction with the reversed phase resin. Aggregated species are usually eluted at higher acetonitrile concentrations. In addition to resolving misfolded forms of proteins from the desired form, the reversed phase step also removes endotoxin from the samples.

Fractions containing the desired folded PRO polypeptide are pooled and the acetonitrile removed using a gentle stream of nitrogen directed at the solution. Proteins are formulated into 20 mM Hepes, pH 6.8 with 0.14M sodium chloride and 4% mannitol by dialysis or by gel filtration using G25 Superfine (Pharmacia) resins equilibrated in the formulation buffer and sterile filtered.

Many of the PRO polypeptides disclosed herein were successfully expressed as described above.

Example 7

Expression of PRO in Mammalian Cells

This example illustrates preparation of a potentially glycosylated form of PRO by recombinant expression in mammalian cells.

The vector, pRK5 (see EP 307,247, published Mar. 15, 1989), is employed as the expression vector. Optionally, the PRO DNA is ligated into pRK5 with selected restriction enzymes to allow insertion of the PRO DNA using ligation methods such as described in Sambrook et al., supra. The resulting vector is called pRK5-PRO.

In one embodiment, the selected host cells may be 293 cells. Human 293 cells (ATCC CCL 1573) are grown to confluence in tissue culture plates in medium such as DMEM supplemented with fetal calf serum and optionally, nutrient components and/or antibiotics. About 10 μg pRK5-PRO DNA is mixed with about 1 μg DNA encoding the VA RNA gene [Thimmappaya et al., *Cell,* 31:543 (1982)] and dissolved in 500 μl of 1 mM Tris-HCl, 0.1 mM EDTA, 0.227 M $CaCl_2$. To this mixture is added, dropwise, 500 μl of 50 mM HEPES (pH 7.35), 280 mM NaCl, 1.5 mM $NaPO_4$, and a precipitate is allowed to form for 10 minutes at 25° C. The precipitate is suspended and added to the 293 cells and allowed to settle for about four hours at 37° C. The culture medium is aspirated off and 2 ml of 20% glycerol in PBS is added for 30 seconds. The 293 cells are then washed with serum free medium, fresh medium is added and the cells are incubated for about 5 days.

Approximately 24 hours after the transfections, the culture medium is removed and replaced with culture medium (alone) or culture medium containing 200 μCi/ml $^{35}$S-cysteine and 200 μLCi/ml $^{35}$S-methionine. After a 12 hour incubation, the conditioned medium is collected, concentrated on a spin filter, and loaded onto a 15% SDS gel. The processed gel may be dried and exposed to film for a selected period of time to reveal the presence of PRO polypeptide. The cultures containing transfected cells may undergo further incubation (in serum free medium) and the medium is tested in selected bioassays.

In an alternative technique, PRO may be introduced into 293 cells transiently using the dextran sulfate method described by Somparyrac et al., *Proc. Natl. Acad. Sci.,* 12:7575 (1981). 293 cells are grown to maximal density in a spinner flask and 700 μg pRK5-PRO DNA is added. The cells are first concentrated from the spinner flask by centrifugation and washed with PBS. The DNA-dextran precipitate is incubated on the cell pellet for four hours. The cells are treated with 20% glycerol for 90 seconds, washed with tissue culture medium, and re-introduced into the spinner flask containing tissue culture medium, 5 μg/ml bovine insulin and 0.1 μg/ml bovine transferrin. After about four days, the conditioned media is centrifuged and filtered to remove cells and debris. The sample containing expressed PRO can then be concentrated and purified by any selected method, such as dialysis and/or column chromatography.

In another embodiment, PRO can be expressed in CHO cells. The pRK5-PRO can be transfected into CHO cells using known reagents such as $CaPO_4$ or DEAE-dextran. As described above, the cell cultures can be incubated, and the medium replaced with culture medium (alone) or medium containing a radiolabel such as $^{35}$S-methionine. After determining the presence of PRO polypeptide, the culture medium may be replaced with serum free medium. Preferably, the cultures are incubated for about 6 days, and then the conditioned medium is harvested. The medium containing the expressed PRO can then be concentrated and purified by any selected method.

Epitope-tagged PRO may also be expressed in host CHO cells. The PRO may be subcloned out of the pRK5 vector. The subclone insert can undergo PCR to fuse in frame with a selected epitope tag such as a poly-his tag into a Baculovirus expression vector. The poly-his tagged PRO insert can then be subcloned into a SV40 driven vector containing a selection marker such as DHFR for selection of stable clones. Finally, the CHO cells can be transfected (as described above) with the SV40 driven vector. Labeling may be performed, as described above, to verify expression. The culture medium containing the expressed poly-His tagged PRO can then be concentrated and purified by any selected method, such as by $Ni^2$+-chelate affinity chromatography.

PRO may also be expressed in CHO and/or COS cells by a transient expression procedure or in CHO cells by another stable expression procedure.

Stable expression in CHO cells is performed using the following procedure. The proteins are expressed as an IgG construct (immunoadhesin), in which the coding sequences for the soluble forms (e.g. extracellular domains) of the respective proteins are fused to an IgGI constant region sequence containing the hinge, CH2 and CH2 domains and/or is a poly-His tagged form.

Following PCR amplification, the respective DNAs are subcloned in a CHO expression vector using standard techniques as described in Ausubel et al., *Current Protocols of Molecular Biology,* Unit 3.16, John Wiley and Sons (1997). CHO expression vectors are constructed to have compatible restriction sites 5' and 3' of the DNA of interest to allow the convenient shuttling of cDNA's. The vector used expression in CHO cells is as described in Lucas et al., *Nucl. Acids Res.* 24:9 (1774-1779 (1996), and uses the SV40 early promoter/enhancer to drive expression of the cDNA of interest and dihydrofolate reductase (DHFR). DHFR expression permits selection for stable maintenance of the plasmid following transfection.

Twelve micrograms of the desired plasmid DNA is introduced into approximately 10 million CHO cells using commercially available transfection reagents Superfect® (Qiagen), Dosper® or Fugene® (Boehringer Mannheim). The cells are grown as described in Lucas et al., supra. Approximately $3\times10^7$ cells are frozen in an ampule for further growth and production as described below.

The ampules containing the plasmid DNA are thawed by placement into water bath and mixed by vortexing. The contents are pipetted into a centrifuge tube containing 10 mLs of media and centrifuged at 1000 rpm for 5 minutes. The supernatant is aspirated and the cells are resuspended in 10 mL of selective media (0.2 μm filtered PS20 with 5% 0.2 μm diafiltered fetal bovine serum). The cells are then aliquoted into a 100 mL spinner containing 90 mL of selective media. After 1-2 days, the cells are transferred into a 250 mL spinner filled with 150 mL selective growth medium and incubated at 37° C. After another 2-3 days, 250 mL, 500 mL and 2000 mL spinners are seeded with $3\times10^5$ cells/mL. The cell media is exchanged with fresh media by centrifugation and resuspension in production medium. Although any suitable CHO media may be employed, a production medium described in U.S. Pat. No. 5,122,469, issued Jun. 16, 1992 may actually be used. A 3 L production spinner is seeded at $1.2\times10^6$ cells/mL. On day 0, the cell number pH ie determined. On day 1, the spinner is sampled and sparging with filtered air is commenced. On day 2, the spinner is sampled, the temperature shifted to 33° C., and 30 mL of 500 g/L glucose and 0.6 mL of 10% antifoam (e.g., 35% polydimethylsiloxane emulsion, Dow Corning 365 Medical Grade Emulsion) taken. Throughout the production, the pH is adjusted as necessary to keep it at around 7.2. After 10 days, or until the viability dropped below 70%, the cell culture is harvested by centrifugation and filtering through a 0.22 μm filter. The filtrate was either stored at 4° C. or immediately loaded onto columns for purification.

For the poly-His tagged constructs, the proteins are purified using a Ni-NTA column (Qiagen). Before purification, imidazole is added to the conditioned media to a concentration of 5 mM. The conditioned media is pumped onto a 6 ml Ni-NTA column equilibrated in 20 mM Hepes, pH 7.4, buffer containing 0.3 M NaCl and 5 mM imidazole at a flow rate of 4-5 ml/min. at 4° C. After loading, the column is washed with additional equilibration buffer and the protein eluted with equilibration buffer containing 0.25 M imidazole. The highly purified protein is subsequently desalted into a storage buffer containing 10 mM Hepes, 0.14 M NaCi and 4% mannitol, pH 6.8, with a 25 ml G25 Superfine (Pharmacia) column and stored at −80° C.

Immunoadhesin (Fc-containing) constructs are purified from the conditioned media as follows. The conditioned medium is pumped onto a 5 ml Protein A column (Pharmacia) which had been equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 µL of 1 M Tris buffer, pH 9. The highly purified protein is subsequently desalted into storage buffer as described above for the poly-His tagged proteins. The homogeneity is assessed by SDS polyacrylamide gels and by N-terminal amino acid sequencing by Edman degradation.

Many of the PRO polypeptides disclosed herein were successfully expressed as described above.

Example 8

Expression of PRO in Yeast

The following method describes recombinant expression of PRO in yeast.

First, yeast expression vectors are constructed for intracellular production or secretion of PRO from the ADH2/GAPDH promoter. DNA encoding PRO and the promoter is inserted into suitable restriction enzyme sites in the selected plasmid to direct intracellular expression of PRO. For secretion, DNA encoding PRO can be cloned into the selected plasmid, together with DNA encoding the ADH2/GAPDH promoter, a native PRO signal peptide or other mammalian signal peptide, or, for example, a yeast alpha-factor or invertase secretory signal/leader sequence, and linker sequences (if needed) for expression of PRO.

Yeast cells, such as yeast strain AB 110, can then be transformed with the expression plasmids described above and cultured in selected fermentation media. The transformed yeast supernatants can be analyzed by precipitation with 10% trichloroacetic acid and separation by SDS-PAGE, followed by staining of the gels with Coomassie Blue stain.

Recombinant PRO can subsequently be isolated and purified by removing the yeast cells from the fermentation medium by centrifugation and then concentrating the medium using selected cartridge filters. The concentrate containing PRO may further be purified using selected column chromatography resins.

Many of the PRO polypeptides disclosed herein were successfully expressed as described above.

Example 9

Expression of PRO in Baculovirus-Infected Insect Cells

The following method describes recombinant expression of PRO in Baculovirus-infected insect cells.

The sequence coding for PRO is fused upstream of an epitope tag contained within a baculovirus expression vector. Such epitope tags include poly-his tags and immunoglobulin tags (like Fc regions of IgG). A variety of plasmids may be employed, including plasmids derived from commercially available plasmids such as pVL1393 (Novagen). Briefly, the sequence encoding PRO or the desired portion of the coding sequence of PRO such as the sequence encoding the extracellular domain of a transmembrane protein or the sequence encoding the mature protein if the protein is extracellular is amplified by PCR with primers complementary to the 5' and 3' regions. The 5' primer may incorporate flanking (selected) restriction enzyme sites. The product is then digested with those selected restriction enzymes and subcloned into the expression vector.

Recombinant baculovirus is generated by co-transfecting the above plasmid and BaculoGold™ virus DNA (Pharmingen) into *Spodoptera frugiperda* ("Sf9") cells (ATCC CRL 1711) using lipofectin (commercially available from GIBCO-BRL). After 4-5 days of incubation at 28° C., the released viruses are harvested and used for further amplifications. Viral infection and protein expression are performed as described by O'Reilley et al., *Baculovirus expression vectors: A Laboratory Manual,* Oxford: Oxford University Press (1994).

Expressed poly-his tagged PRO can then be purified, for example, by $Ni^{2+}$-chelate affinity chromatography as follows. Extracts are prepared from recombinant virus-infected Sf9 cells as described by Rupert et al., *Nature* 362:175-179 (1993). Briefly, Sf9 cells are washed, resuspended in sonication buffer (25 mL Hepes, pH 7.9; 12.5 mM $MgCl_2$; 0.1 mM EDTA; 10% glycerol; 0.1% NP-40; 0.4 M KCl), and sonicated twice for 20 seconds on ice. The sonicates are cleared by centrifugation, and the supernatant is diluted 50-fold in loading buffer (50 mM phosphate, 300 mM NaCl, 10% glycerol, pH 7.8) and filtered through a 0.45 µm filter. A $Ni^{2+}$-NTA agarose column (commercially available from Qiagen) is prepared with a bed volume of 5 mL, washed with 25 mL of water and equilibrated with 25 mL of loading buffer. The filtered cell extract is loaded onto the column at 0.5 mL per minute. The column is washed to baseline $A_{280}$ with loading buffer, at which point fraction collection is started. Next, the column is washed with a secondary wash buffer (50 mM phosphate; 300 mM NaCl, 10% glycerol, pH 6.0), which elutes nonspecifically bound protein. After reaching $A_{280}$ baseline again, the column is developed with a 0 to 500 mM Imidazole gradient in the secondary wash buffer. One mL fractions are collected and analyzed by SDS-PAGE and silver staining or Western blot with $Ni^{2+}$-NTA-conjugated to alkaline phosphatase (Qiagen). Fractions containing the eluted $His_{10}$-tagged PRO are pooled and dialyzed against loading buffer.

Alternatively, purification of the IgG tagged (or Fe tagged) PRO can be performed using known chromatography techniques, including for instance, Protein A or protein G column chromatography.

Many of the PRO polypeptides disclosed herein were successfully expressed as described above.

Example 10

Preparation of Antibodies that Bind PRO

This example illustrates preparation of monoclonal antibodies which can specifically bind PRO.

Techniques for producing the monoclonal antibodies are known in the art and are described, for instance, in Goding, supra. Immunogens that may be employed include purified PRO, fusion proteins containing PRO, and cells expressing recombinant PRO on the cell surface. Selection of the immunogen can be made by the skilled artisan without undue experimentation.

Mice, such as Balb/c, are immunized with the PRO immunogen emulsified in complete Freund's adjuvant and injected subcutaneously or intraperitoneally in an amount from 1-100 micrograms. Alternatively, the immunogen is emulsified in MPL-TDM adjuvant (Ribi Immunochemical Research, Hamilton, Mont.) and injected into the animal's hind foot pads. The immunized mice are then boosted 10 to 12 days later with additional immunogen emulsified in the selected adjuvant. Thereafter, for several weeks, the mice may also be boosted with additional immunization injections. Serum samples may be periodically obtained from the mice by retro-orbital bleeding for testing in ELISA assays to detect anti-PRO antibodies.

After a suitable antibody titer has been detected, the animals "positive" for antibodies can be injected with a final intravenous injection of PRO. Three to four days later, the mice are sacrificed and the spleen cells are harvested. The spleen cells are then fused (using 35% polyethylene glycol) to a selected murine myeloma cell line such as P3X63AgU.1, available from ATCC, No. CRL 1597. The fusions generate hybridoma cells which can then be plated in 96 well tissue culture plates containing HAT (hypoxanthine, aminopterin, and thymidine) medium to inhibit proliferation of non-fused cells, myeloma hybrids, and spleen cell hybrids.

The hybridoma cells will be screened in an ELISA for reactivity against PRO. Determination of "positive" hybridoma cells secreting the desired monoclonal antibodies against PRO is within the skill in the art.

The positive hybridoma cells can be injected intraperitoneally into syngeneic Balb/c mice to produce ascites containing the anti-PRO monoclonal antibodies. Alternatively, the hybridoma cells can be grown in tissue culture flasks or roller bottles. Purification of the monoclonal antibodies produced in the ascites can be accomplished using ammonium sulfate precipitation, followed by gel exclusion chromatography. Alternatively, affinity chromatography based upon binding of antibody to protein A or protein G can be employed.

Example 11

Purification of PRO Polypeptides Using Specific Antibodies

Native or recombinant PRO polypeptides may be purified by a variety of standard techniques in the art of protein purification. For example, pro-PRO polypeptide, mature PRO polypeptide, or pre-PRO polypeptide is purified by immunoaffinity chromatography using antibodies specific for the PRO polypeptide of interest. In general, an immunoaffinity column is constructed by covalently coupling the anti-PRO polypeptide antibody to an activated chromatographic resin.

Polyclonal immunoglobulins are prepared from immune sera either by precipitation with ammonium sulfate or by purification on immobilized Protein A (Pharmacia LKB Biotechnology, Piscataway, N.J.). Likewise, monoclonal antibodies are prepared from mouse ascites fluid by ammonium sulfate precipitation or chromatography on immobilized Protein A. Partially purified immunoglobulin is covalently attached to a chromatographic resin such as CnBr-activated SEPHAROSE™ (Pharmacia LKB Biotechnology). The antibody is coupled to the resin, the resin is blocked, and the derivative resin is washed according to the manufacturer's instructions.

Such an immunoaffinity column is utilized in the purification of PRO polypeptide by preparing a fraction from cells containing PRO polypeptide in a soluble form. This preparation is derived by solubilization of the whole cell or of a subcellular fraction obtained via differential centrifugation by the addition of detergent or by other methods well known in the art. Alternatively, soluble PRO polypeptide containing a signal sequence may be secreted in useful quantity into the medium in which the cells are grown.

A soluble PRO polypeptide-containing preparation is passed over the immunoaffinity column, and the column is washed under conditions that allow the preferential absorbance of PRO polypeptide (e.g., high ionic strength buffers in the presence of detergent). Then, the column is eluted under conditions that disrupt antibody/PRO polypeptide binding (e.g., a low pH buffer such as approximately pH 2-3, or a high concentration of a chaotrope such as urea or thiocyanate ion), and PRO polypeptide is collected.

Example 12

Drug Screening

This invention is particularly useful for screening compounds by using PRO polypeptides or binding fragment thereof in any of a variety of drug screening techniques. The PRO polypeptide or fragment employed in such a test may either be free in solution, affixed to a solid support, borne on a cell surface, or located intracellularly. One method of drug screening utilizes eukaryotic or prokaryotic host cells which are stably transformed with recombinant nucleic acids expressing the PRO polypeptide or fragment. Drugs are screened against such transformed cells in competitive binding assays. Such cells, either in viable or fixed form, can be used for standard binding assays. One may measure, for example, the formation of complexes between PRO polypeptide or a fragment and the agent being tested. Alternatively, one can examine the diminution in complex formation between the PRO polypeptide and its target cell or target receptors caused by the agent being tested.

Thus, the present invention provides methods of screening for drugs or any other agents which can affect a PRO polypeptide-associated disease or disorder. These methods comprise contacting such an agent with an PRO polypeptide or fragment thereof and assaying (I) for the presence of a complex between the agent and the PRO polypeptide or fragment, or (ii) for the presence of a complex between the PRO polypeptide or fragment and the cell, by methods well known in the art. In such competitive binding assays, the PRO polypeptide or fragment is typically labeled. After suitable incubation, free PRO polypeptide or fragment is separated from that present in bound form, and the amount of free or uncomplexed label is a measure of the ability of the particular agent to bind to PRO polypeptide or to interfere with the PRO polypeptide/cell complex.

Another technique for drug screening provides high throughput screening for compounds having suitable binding affinity to a polypeptide and is described in detail in WO 84/03564, published on Sep. 13, 1984. Briefly stated, large numbers of different small peptide test compounds are synthesized on a solid substrate, such as plastic pins or some other surface. As applied to a PRO polypeptide, the peptide test compounds are reacted with PRO polypeptide and washed. Bound PRO polypeptide is detected by methods well known in the art. Purified PRO polypeptide can also be coated directly onto plates for use in the aforementioned drug screening techniques. In addition, non-neutralizing antibodies can be used to capture the peptide and immobilize it on the solid support.

This invention also contemplates the use of competitive drug screening assays in which neutralizing antibodies capable of binding PRO polypeptide specifically compete with a test compound for binding to PRO polypeptide or fragments thereof. In this manner, the antibodies can be used to detect the presence of any peptide which shares one or more antigenic determinants with PRO polypeptide.

Example 13

Rational Drug Design

The goal of rational drug design is to produce structural analogs of biologically active polypeptide of interest (i.e., a PRO polypeptide) or of small molecules with which they interact, e.g., agonists, antagonists, or inhibitors. Any of these examples can be used to fashion drugs which are more active or stable forms of the PRO polypeptide or which enhance or interfere with the function of the PRO polypeptide in vivo (cf., Hodgson, *Bio/Technology,* 9: 19-21 (1991)).

In one approach, the three-dimensional structure of the PRO polypeptide, or of an PRO polypeptide-inhibitor complex, is determined by x-ray crystallography, by computer modeling or, most typically, by a combination of the two approaches. Both the shape and charges of the PRO polypeptide must be ascertained to elucidate the structure and to determine active site(s) of the molecule. Less often, useful information regarding the structure of the PRO polypeptide may be gained by modeling based on the structure of homologous proteins. In both cases, relevant structural information is used to design analogous PRO polypeptide-like molecules or to identify efficient inhibitors. Useful examples of rational drug design may include molecules which have improved activity or stability as shown by Braxton and Wells, *Biochemistry,* 31:7796-7801 (1992) or which act as inhibitors, agonists, or antagonists of native peptides as shown by Athauda et al., *J. Biochem.* 113:742-746 (1993).

It is also possible to isolate a target-specific antibody, selected by functional assay, as described above, and then to solve its crystal structure. This approach, in principle, yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced peptides. The isolated peptides would then act as the pharmacore.

By virtue of the present invention, sufficient amounts of the PRO polypeptide may be made available to perform such analytical studies as X-ray crystallography. In addition, knowledge of the PRO polypeptide amino acid sequence provided herein will provide guidance to those employing computer modeling techniques in place of or in addition to x-ray crystallography.

Example 14

Identification of PRO Polypeptides That Stimulate TNF-α Release In Human Blood (Assay 128)

This assay shows that certain PRO polypeptides of the present invention act to stimulate the release of TNF-α in human blood. PRO polypeptides testing positive in this assay are useful for, among other things, research purposes where stimulation of the release of TNF-α would be desired and for the therapeutic treatment of conditions wherein enhanced TNF-α release would be beneficial. Specifically, 200 μl of human blood supplemented with 50 mM Hepes buffer (pH 7.2) is aliquoted per well in a 96 well test plate. To each well is then added 300 μl of either the test PRO polypeptide in 50 mM Hepes buffer (at various concentrations) or 50 mM Hepes buffer alone (negative control) and the plates are incubated at 37° C. for 6 hours. The samples are then centrifuged and 50 μl of plasma is collected from each well and tested for the presence of TNF-α by ELISA assay. A positive in the assay is a higher amount of TNF-α in the PRO polypeptide treated samples as compared to the negative control samples.

The following PRO polypeptides tested positive in this assay: PRO1079, PRO827, PRO791, PRO1131, PRO1316, PRO1183, PRO1343, PRO1760, PRO1567, and PRO4333.

Example 15

Promotion of Chondrocyte Redifferentiation (Assay 129)

This assay is designed to determine whether PRO polypeptides of the present invention show the ability to induce the proliferation and/or redifferentiation of chondrocytes in culture. PRO polypeptides testing positive in this assay would be expected to be useful for the therapeutic treatment of various bone and/or cartilage disorders such as, for example, sports injuries and arthritis.

Porcine chondrocytes are isolated by overnight collagenase digestion of articular cartilage of the metacarpophalangeal joint of 4-6 month old female pigs. The isolated cells are then seeded at 25,000 cells/$cm^2$ in Ham F-12 containing 10% FBS and 4 μg/ml gentamycin. The culture media is changed every third day. On day 12, the cells are seeded in 96 well plates at 5,000 cells/well in 100 μl of the same media without serum and 100 μl of either serum-free medium (negative control), staurosporin (final concentration of 5 nM; positive control) or the test PRO polypeptide are added to give a final volume of 200 μl/well. After 5 days at 37° C., 22 μl of media containing 100 μg/ml Hoechst 33342 and 50 μg/ml 5-CFDA is added to each well and incubated for an additional 10 minutes at 37° C. A picture of the green fluorescence is taken for each well and the differentiation state of the chondrocytes is calculated by morphometric analysis. A positive result in the assay is obtained when the >50% of the PRO polypeptide treated cells are differentiated (compared to the background obtained by the negative control).

PRO6029 polypeptide tested positive in this assay.

Example 16

Microarray Analysis to Detect Overexpression of PRO Polypeptides in Cancerous Tumors Nucleic acid microarrays, often containing thousands of gene sequences, are useful for identifying differentially expressed genes in diseased tissues as compared to their normal counterparts. Using nucleic acid microarrays, test and control mRNA samples from test and control tissue samples are reverse transcribed and labeled to generate cDNA probes. The cDNA probes are then hybridized to an array of nucleic acids immobilized on a solid support. The array is configured such that the sequence and position of each member of the array is known. For example, a selection of genes known to be expressed in certain disease states may be arrayed on a solid support. Hybridization of a labeled probe with a particular array member indicates that the sample from which the probe was derived expresses that gene. If the hybridization signal of a probe from a test (disease tissue) sample is greater than hybridization signal of a probe from a control (normal tissue) sample, the gene or genes overexpressed in the disease tissue are identified. The implication of this result is that an overexpressed protein in a diseased tissue is useful not only as a diagnostic marker for the presence of the disease condition, but also as a therapeutic target for treatment of the disease condition.

The methodology of hybridization of nucleic acids and microarray technology is well known in the art. In the present example, the specific preparation of nucleic acids for hybridization and probes, slides, and hybridization conditions are all detailed in U.S. Provisional Patent Application Ser. No. 60/193,767, filed on Mar. 31, 2000 and which is herein incorporated by reference.

In the present example, cancerous tumors derived from various human tissues were studied for PRO polypeptide-encoding gene expression relative to non-cancerous human tissue in an attempt to identify those PRO polypeptides which are overexpressed in cancerous tumors. Two sets of experimental data were generated. In one set, cancerous human colon tumor tissue and matched non-cancerous human colon tumor tissue from the same patient ("matched colon control") were obtained and analyzed for PRO polypeptide expression using the above described microarray technology. In the second set of data, cancerous human tumor tissue from any of a variety of different human tumors was obtained and compared to a "universal" epithelial control sample which was prepared by pooling non-cancerous human tissues of epithelial origin, including liver, kidney, and lung. mRNA isolated from the pooled tissues represents a mixture of expressed gene products from these different tissues. Microarray hybridization experiments using the pooled control samples generated a linear plot in a 2-color analysis. The slope of the line generated in a 2-color analysis was then used to normalize the ratios of (test:control detection) within each experiment. The normalized ratios from various experiments were then compared and used to identify clustering of gene expression. Thus, the pooled "universal control" sample not only allowed effective relative gene expression determinations in a simple 2-sample comparison, it also allowed multi-sample comparisons across several experiments.

In the present experiments, nucleic acid probes derived from the herein described PRO polypeptide-encoding nucleic acid sequences were used in the creation of the microarray and RNA from the tumor tissues, listed above were used for the hybridization thereto. A value based upon the normalized ratio:experimental ratio was designated as a "cutoff ratio". Only values that were above this cutoff ratio were determined to be significant. Table 8 below shows the results of these experiments, demonstrating that various PRO polypeptides of the present invention are significantly overexpressed in various human tumor tissues as compared to a non-cancerous human tissue control. As described above, these data demonstrate that the PRO polypeptides of the present invention are useful not only as diagnostic markers for the presence of one or more cancerous tumors, but also serve as therapeutic targets for the treatment of those tumors.

TABLE 8

| Molecule | is overexpressed in: | as compared to: |
|---|---|---|
| PRO276 | lung tumor | universal normal control |
| PRO284 | colon tumor | universal normal control |
| PRO284 | lung tumor | universal normal control |
| PRO284 | breast tumor | universal normal control |
| PRO193 | colon tumor | universal normal control |
| PRO193 | lung tumor | universal normal control |
| PRO193 | breast tumor | universal normal control |
| PRO193 | prostate tumor | universal normal control |
| PRO190 | colon tumor | universal normal control |

TABLE 8-continued

| Molecule | is overexpressed in: | as compared to: |
|---|---|---|
| PRO190 | lung tumor | universal normal control |
| PRO190 | breast tumor | universal normal control |
| PRO180 | colon tumor | universal normal control |
| PRO180 | lung tumor | universal normal control |
| PRO180 | breast tumor | universal normal control |
| PRO194 | colon tumor | universal normal control |
| PRO194 | lung tumor | universal normal control |
| PRO194 | breast tumor | universal normal control |
| PRO194 | cervical tumor | universal normal control |
| PRO218 | colon tumor | universal normal control |
| PRO218 | lung tumor | universal normal control |
| PRO260 | colon tumor | universal normal control |
| PRO260 | lung tumor | universal normal control |
| PRO260 | breast tumor | universal normal control |
| PRO260 | rectal tumor | universal normal control |
| PRO233 | colon tumor | universal normal control |
| PRO233 | lung tumor | universal normal control |
| PRO233 | breast tumor | universal normal control |
| PRO234 | colon tumor | universal normal control |
| PRO234 | lung tumor | universal normal control |
| PRO234 | breast tumor | universal normal control |
| PRO234 | liver tumor | universal normal control |
| PRO236 | colon tumor | universal normal control |
| PRO236 | lung tumor | universal normal control |
| PRO236 | breast tumor | universal normal control |
| PRO244 | colon tumor | universal normal control |
| PRO244 | lung tumor | universal normal control |
| PRO262 | colon tumor | universal normal control |
| PRO262 | lung tumor | universal normal control |
| PRO262 | breast tumor | universal normal control |
| PRO271 | colon tumor | universal normal control |
| PRO271 | lung tumor | universal normal control |
| PRO268 | colon tumor | universal normal control |
| PRO268 | lung tumor | universal normal control |
| PRO268 | breast tumor | universal normal control |
| PRO270 | colon tumor | universal normal control |
| PRO270 | lung tumor | universal normal control |
| PRO270 | breast tumor | universal normal control |
| PRO270 | liver tumor | universal normal control |
| PRO355 | lung tumor | universal normal control |
| PRO355 | breast tumor | universal normal control |
| PRO355 | prostate tumor | universal normal control |
| PRO298 | colon tumor | universal normal control |
| PRO298 | lung tumor | universal normal control |
| PRO298 | breast tumor | universal normal control |
| PRO299 | colon tumor | universal normal control |
| PRO299 | lung tumor | universal normal control |
| PRO299 | breast tumor | universal normal control |
| PRO296 | colon tumor | universal normal control |
| PRO296 | breast tumor | universal normal control |
| PRO329 | colon tumor | universal normal control |
| PRO329 | lung tumor | universal normal control |
| PRO329 | breast tumor | universal normal control |
| PRO330 | colon tumor | universal normal control |
| PRO330 | lung tumor | universal normal control |
| PRO294 | lung tumor | universal normal control |
| PRO294 | breast tumor | universal normal control |
| PRO300 | colon tumor | universal normal control |
| PRO300 | lung tumor | universal normal control |
| PRO300 | breast tumor | universal normal control |
| PRO307 | lung tumor | universal normal control |
| PRO334 | colon tumor | universal normal control |
| PRO334 | lung tumor | universal normal control |
| PRO334 | breast tumor | universal normal control |
| PRO334 | prostate tumor | universal normal control |
| PRO352 | colon tumor | universal normal control |
| PRO352 | lung tumor | universal normal control |
| PRO352 | breast tumor | universal normal control |
| PRO352 | liver tumor | universal normal control |
| PRO710 | breast tumor | universal normal control |
| PRO873 | colon tumor | universal normal control |
| PRO873 | lung tumor | universal normal control |
| PRO873 | breast tumor | universal normal control |
| PRO873 | prostate tumor | universal normal control |
| PRO354 | colon tumor | universal normal control |
| PRO354 | lung tumor | universal normal control |
| PRO354 | breast tumor | universal normal control |

TABLE 8-continued

| Molecule | is overexpressed in: | as compared to: |
|---|---|---|
| PRO1151 | lung tumor | universal normal control |
| PRO1151 | breast tumor | universal normal control |
| PRO382 | colon tumor | universal normal control |
| PRO382 | lung tumor | universal normal control |
| PRO382 | breast tumor | universal normal control |
| PRO1864 | lung tumor | universal normal control |
| PRO1864 | breast tumor | universal normal control |
| PRO1864 | liver tumor | universal normal control |
| PRO386 | colon tumor | universal normal control |
| PRO386 | lung tumor | universal normal control |
| PRO386 | prostate tumor | universal normal control |
| PRO541 | colon tumor | universal normal control |
| PRO541 | lung tumor | universal normal control |
| PRO541 | breast tumor | universal normal control |
| PRO852 | breast tumor | universal normal control |
| PRO700 | colon tumor | universal normal control |
| PRO700 | lung tumor | universal normal control |
| PRO700 | breast tumor | universal normal control |
| PRO700 | rectal tumor | universal normal control |
| PRO708 | colon tumor | universal normal control |
| PRO708 | lung tumor | universal normal control |
| PRO708 | breast tumor | universal normal control |
| PRO707 | colon tumor | universal normal control |
| PRO707 | lung tumor | universal normal control |
| PRO864 | colon tumor | universal normal control |
| PRO864 | lung tumor | universal normal control |
| PRO864 | breast tumor | universal normal control |
| PRO706 | colon tumor | universal normal control |
| PRO706 | lung tumor | universal normal control |
| PRO706 | breast tumor | universal normal control |
| PRO706 | liver tumor | universal normal control |
| PRO732 | lung tumor | universal normal control |
| PRO732 | breast tumor | universal normal control |
| PRO732 | cervical tumor | universal normal control |
| PRO537 | colon tumor | universal normal control |
| PRO537 | lung tumor | universal normal control |
| PRO537 | breast tumor | universal normal control |
| PRO545 | lung tumor | universal normal control |
| PRO545 | breast tumor | universal normal control |
| PRO718 | lung tumor | universal normal control |
| PRO718 | breast tumor | universal normal control |
| PRO872 | lung tumor | universal normal control |
| PRO872 | breast tumor | universal normal control |
| PRO872 | liver tumor | universal normal control |
| PRO704 | colon tumor | universal normal control |
| PRO704 | lung tumor | universal normal control |
| PRO704 | breast tumor | universal normal control |
| PRO705 | lung tumor | universal normal control |
| PRO705 | breast tumor | universal normal control |
| PRO871 | lung tumor | universal normal control |
| PRO871 | breast tumor | universal normal control |
| PRO871 | liver tumor | universal normal control |
| PRO702 | lung tumor | universal normal control |
| PRO944 | colon tumor | universal normal control |
| PRO944 | lung tumor | universal normal control |
| PRO944 | rectal tumor | universal normal control |
| PRO739 | lung tumor | universal normal control |
| PRO739 | breast tumor | universal normal control |
| PRO739 | prostate tumor | universal normal control |
| PRO941 | colon tumor | universal normal control |
| PRO941 | lung tumor | universal normal control |
| PRO941 | breast tumor | universal normal control |
| PRO941 | rectal tumor | universal normal control |
| PRO1082 | lung tumor | universal normal control |
| PRO1082 | breast tumor | universal normal control |
| PRO1133 | colon tumor | universal normal control |
| PRO1133 | lung tumor | universal normal control |
| PRO983 | colon tumor | universal normal control |
| PRO983 | lung tumor | universal normal control |
| PRO983 | breast tumor | universal normal control |
| PRO784 | colon tumor | universal normal control |
| PRO784 | lung tumor | universal normal control |
| PRO784 | breast tumor | universal normal control |
| PRO784 | prostate tumor | universal normal control |
| PRO783 | colon tumor | universal normal control |
| PRO783 | lung tumor | universal normal control |
| PRO783 | breast tumor | universal normal control |

TABLE 8-continued

| Molecule | is overexpressed in: | as compared to: |
|---|---|---|
| PRO783 | liver tumor | universal normal control |
| PRO940 | colon tumor | universal normal control |
| PRO940 | lung tumor | universal normal control |
| PRO940 | breast tumor | universal normal control |
| PRO768 | colon tumor | universal normal control |
| PRO768 | lung tumor | universal normal control |
| PRO768 | breast tumor | universal normal control |
| PRO1079 | colon tumor | universal normal control |
| PRO1079 | lung tumor | universal normal control |
| PRO1079 | breast tumor | universal normal control |
| PRO1079 | rectal tumor | universal normal control |
| PRO1078 | colon tumor | universal normal control |
| PRO1078 | lung tumor | universal normal control |
| PRO1018 | colon tumor | universal normal control |
| PRO1018 | lung tumor | universal normal control |
| PRO1018 | breast tumor | universal normal control |
| PRO793 | colon tumor | universal normal control |
| PRO793 | lung tumor | universal normal control |
| PRO793 | breast tumor | universal normal control |
| PRO793 | rectal tumor | universal normal control |
| PRO1773 | colon tumor | universal normal control |
| PRO1773 | lung tumor | universal normal control |
| PRO1773 | prostate tumor | universal normal control |
| PRO1014 | lung tumor | universal normal control |
| PRO1014 | breast tumor | universal normal control |
| PRO1013 | colon tumor | universal normal control |
| PRO1013 | lung tumor | universal normal control |
| PRO1013 | breast tumor | universal normal control |
| PRO1013 | liver tumor | universal normal control |
| PRO937 | colon tumor | universal normal control |
| PRO937 | lung tumor | universal normal control |
| PRO937 | breast tumor | universal normal control |
| PRO937 | cervical tumor | universal normal control |
| PRO937 | rectal tumor | universal normal control |
| PRO1477 | lung tumor | universal normal control |
| PRO1477 | breast tumor | universal normal control |
| PRO1477 | rectal tumor | universal normal control |
| PRO842 | colon tumor | universal normal control |
| PRO842 | lung tumor | universal normal control |
| PRO842 | breast tumor | universal normal control |
| PRO839 | colon tumor | universal normal control |
| PRO1180 | colon tumor | universal normal control |
| PRO1180 | lung tumor | universal normal control |
| PRO1180 | liver tumor | universal normal control |
| PRO1134 | lung tumor | universal normal control |
| PRO1134 | breast tumor | universal normal control |
| PRO1134 | prostate tumor | universal normal control |
| PRO1115 | colon tumor | universal normal control |
| PRO1115 | lung tumor | universal normal control |
| PRO1115 | breast tumor | universal normal control |
| PRO1277 | colon tumor | universal normal control |
| PRO1277 | lung tumor | universal normal control |
| PRO1135 | lung tumor | universal normal control |
| PRO1135 | breast tumor | universal normal control |
| PRO1135 | cervical tumor | universal normal control |
| PRO827 | colon tumor | universal normal control |
| PRO827 | lung tumor | universal normal control |
| PRO827 | prostate tumor | universal normal control |
| PRO827 | cervical tumor | universal normal control |
| PRO1057 | lung tumor | universal normal control |
| PRO1057 | breast tumor | universal normal control |
| PRO1113 | colon tumor | universal normal control |
| PRO1113 | lung tumor | universal normal control |
| PRO1006 | colon tumor | universal normal control |
| PRO1006 | lung tumor | universal normal control |
| PRO1006 | breast tumor | universal normal control |
| PRO1006 | rectal tumor | universal normal control |
| PRO1074 | lung tumor | universal normal control |
| PRO1074 | rectal tumor | universal normal control |
| PRO1073 | lung tumor | universal normal control |
| PRO1073 | breast tumor | universal normal control |
| PRO1136 | colon tumor | universal normal control |
| PRO1136 | lung tumor | universal normal control |
| PRO1136 | breast tumor | universal normal control |
| PRO1004 | lung tumor | universal normal control |
| PRO1344 | colon tumor | universal normal control |
| PRO1344 | lung tumor | universal normal control |

TABLE 8-continued

| Molecule | is overexpressed in: | as compared to: |
|---|---|---|
| PRO1344 | breast tumor | universal normal control |
| PRO1344 | rectal tumor | universal normal control |
| PRO1110 | colon tumor | universal normal control |
| PRO1110 | lung tumor | universal normal control |
| PRO1110 | breast tumor | universal normal control |
| PRO1378 | colon tumor | universal normal control |
| PRO1378 | lung tumor | universal normal control |
| PRO1378 | prostate tumor | universal normal control |
| PRO1378 | cervical tumor | universal normal control |
| PRO1481 | colon tumor | universal normal control |
| PRO1481 | lung tumor | universal normal control |
| PRO1109 | lung tumor | universal normal control |
| PRO1109 | breast tumor | universal normal control |
| PRO1383 | colon tumor | universal normal control |
| PRO1383 | lung tumor | universal normal control |
| PRO1383 | breast tumor | universal normal control |
| PRO1072 | lung tumor | universal normal control |
| PRO1189 | colon tumor | universal normal control |
| PRO1189 | lung tumor | universal normal control |
| PRO1189 | breast tumor | universal normal control |
| PRO1189 | prostate tumor | universal normal control |
| PRO1003 | colon tumor | universal normal control |
| PRO1003 | lung tumor | universal normal control |
| PRO1003 | breast tumor | universal normal control |
| PRO1003 | liver tumor | universal normal control |
| PRO1003 | rectal tumor | universal normal control |
| PRO1108 | colon tumor | universal normal control |
| PRO1108 | lung tumor | universal normal control |
| PRO1108 | breast tumor | universal normal control |
| PRO1137 | colon tumor | universal normal control |
| PRO1137 | lung tumor | universal normal control |
| PRO1137 | breast tumor | universal normal control |
| PRO1138 | colon tumor | universal normal control |
| PRO1138 | lung tumor | universal normal control |
| PRO1138 | breast tumor | universal normal control |
| PRO1415 | colon tumor | universal normal control |
| PRO1415 | lung tumor | universal normal control |
| PRO1415 | prostate tumor | universal normal control |
| PRO1054 | lung tumor | universal normal control |
| PRO1054 | breast tumor | universal normal control |
| PRO994 | colon tumor | universal normal control |
| PRO994 | lung tumor | universal normal control |
| PRO994 | rectal tumor | universal normal control |
| PRO1069 | lung tumor | universal normal control |
| PRO1069 | breast tumor | universal normal control |
| PRO1411 | colon tumor | universal normal control |
| PRO1411 | lung tumor | universal normal control |
| PRO1129 | lung tumor | universal normal control |
| PRO1129 | rectal tumor | universal normal control |
| PRO1359 | colon tumor | universal normal control |
| PRO1359 | lung tumor | universal normal control |
| PRO1359 | breast tumor | universal normal control |
| PRO1359 | prostate tumor | universal normal control |
| PRO1139 | lung tumor | universal normal control |
| PRO1065 | lung tumor | universal normal control |
| PRO1028 | colon tumor | universal normal control |
| PRO1028 | lung tumor | universal normal control |
| PRO1028 | breast tumor | universal normal control |
| PRO1028 | cervical tumor | universal normal control |
| PRO1027 | colon tumor | universal normal control |
| PRO1027 | lung tumor | universal normal control |
| PRO1027 | breast tumor | universal normal control |
| PRO1140 | colon tumor | universal normal control |
| PRO1140 | breast tumor | universal normal control |
| PRO1291 | colon tumor | universal normal control |
| PRO1291 | breast tumor | universal normal control |
| PRO1105 | colon tumor | universal normal control |
| PRO1105 | lung tumor | universal normal control |
| PRO1026 | lung tumor | universal normal control |
| PRO1026 | prostate tumor | universal normal control |
| PRO1104 | colon tumor | universal normal control |
| PRO1104 | lung tumor | universal normal control |
| PRO1104 | breast tumor | universal normal control |
| PRO1100 | colon tumor | universal normal control |
| PRO1100 | lung tumor | universal normal control |
| PRO1100 | breast tumor | universal normal control |
| PRO1100 | rectal tumor | universal normal control |

TABLE 8-continued

| Molecule | is overexpressed in: | as compared to: |
|---|---|---|
| PRO1141 | lung tumor | universal normal control |
| PRO1772 | colon tumor | universal normal control |
| PRO1772 | lung tumor | universal normal control |
| PRO1772 | breast tumor | universal normal control |
| PRO1772 | cervical tumor | universal normal control |
| PRO1064 | colon tumor | universal normal control |
| PRO1064 | lung tumor | universal normal control |
| PRO1379 | colon tumor | universal normal control |
| PRO1379 | lung tumor | universal normal control |
| PRO1379 | cervical tumor | universal normal control |
| PRO3573 | lung tumor | universal normal control |
| PRO3573 | breast tumor | universal normal control |
| PRO3566 | colon tumor | universal normal control |
| PRO3566 | lung tumor | universal normal control |
| PRO1156 | lung tumor | universal normal control |
| PRO1156 | breast tumor | universal normal control |
| PRO1156 | prostate tumor | universal normal control |
| PRO1098 | colon tumor | universal normal control |
| PRO1098 | lung tumor | universal normal control |
| PRO1098 | rectal tumor | universal normal control |
| PRO1128 | colon tumor | universal normal control |
| PRO1128 | lung tumor | universal normal control |
| PRO1128 | breast tumor | universal normal control |
| PRO1248 | lung tumor | universal normal control |
| PRO1248 | breast tumor | universal normal control |
| PRO1127 | colon tumor | universal normal control |
| PRO1127 | lung tumor | universal normal control |
| PRO1127 | breast tumor | universal normal control |
| PRO1316 | colon tumor | universal normal control |
| PRO1316 | lung tumor | universal normal control |
| PRO1316 | breast tumor | universal normal control |
| PRO1197 | colon tumor | universal normal control |
| PRO1197 | lung tumor | universal normal control |
| PRO1197 | breast tumor | universal normal control |
| PRO1125 | lung tumor | universal normal control |
| PRO1158 | breast tumor | universal normal control |
| PRO1124 | colon tumor | universal normal control |
| PRO1124 | lung tumor | universal normal control |
| PRO1380 | colon tumor | universal normal control |
| PRO1380 | lung tumor | universal normal control |
| PRO1380 | breast tumor | universal normal control |
| PRO1380 | liver tumor | universal normal control |
| PRO1377 | colon tumor | universal normal control |
| PRO1377 | lung tumor | universal normal control |
| PRO1287 | lung tumor | universal normal control |
| PRO1287 | breast tumor | universal normal control |
| PRO1249 | lung tumor | universal normal control |
| PRO1249 | breast tumor | universal normal control |
| PRO1335 | colon tumor | universal normal control |
| PRO1335 | lung tumor | universal normal control |
| PRO1335 | breast tumor | universal normal control |
| PRO3572 | lung tumor | universal normal control |
| PRO1599 | colon tumor | universal normal control |
| PRO1599 | lung tumor | universal normal control |
| PRO1599 | breast tumor | universal normal control |
| PRO1374 | lung tumor | universal normal control |
| PRO1374 | breast tumor | universal normal control |
| PRO1345 | lung tumor | universal normal control |
| PRO1345 | breast tumor | universal normal control |
| PRO1311 | lung tumor | universal normal control |
| PRO1311 | breast tumor | universal normal control |
| PRO1357 | colon tumor | universal normal control |
| PRO1357 | lung tumor | universal normal control |
| PRO1557 | colon tumor | universal normal control |
| PRO1557 | lung tumor | universal normal control |
| PRO1557 | breast tumor | universal normal control |
| PRO1305 | colon tumor | universal normal control |
| PRO1305 | lung tumor | universal normal control |
| PRO1305 | breast tumor | universal normal control |
| PRO1302 | colon tumor | universal normal control |
| PRO1302 | lung tumor | universal normal control |
| PRO1302 | breast tumor | universal normal control |
| PRO1302 | rectal tumor | universal normal control |
| PRO1266 | colon tumor | universal normal control |
| PRO1336 | colon tumor | universal normal control |
| PRO1336 | lung tumor | universal normal control |
| PRO1336 | breast tumor | universal normal control |

TABLE 8-continued

| Molecule | is overexpressed in: | as compared to: |
|---|---|---|
| PRO1278 | colon tumor | universal normal control |
| PRO1278 | lung tumor | universal normal control |
| PRO1270 | breast tumor | universal normal control |
| PRO1298 | colon tumor | universal normal control |
| PRO1298 | lung tumor | universal normal control |
| PRO1301 | lung tumor | universal normal control |
| PRO1301 | breast tumor | universal normal control |
| PRO1268 | colon tumor | universal normal control |
| PRO1268 | breast tumor | universal normal control |
| PRO1327 | lung tumor | universal normal control |
| PRO1327 | breast tumor | universal normal control |
| PRO1328 | colon tumor | universal normal control |
| PRO1328 | lung tumor | universal normal control |
| PRO1328 | breast tumor | universal normal control |
| PRO1329 | colon tumor | universal normal control |
| PRO1329 | lung tumor | universal normal control |
| PRO1329 | breast tumor | universal normal control |
| PRO1339 | colon tumor | universal normal control |
| PRO1339 | lung tumor | universal normal control |
| PRO1342 | colon tumor | universal normal control |
| PRO1342 | lung tumor | universal normal control |
| PRO1342 | breast tumor | universal normal control |
| PRO1342 | rectal tumor | universal normal control |
| PRO1487 | colon tumor | universal normal control |
| PRO1487 | breast tumor | universal normal control |
| PRO3579 | lung tumor | universal normal control |
| PRO3579 | breast tumor | universal normal control |
| PRO1472 | colon tumor | universal normal control |
| PRO1472 | lung tumor | universal normal control |
| PRO1385 | lung tumor | universal normal control |
| PRO1385 | breast tumor | universal normal control |
| PRO1461 | colon tumor | universal normal control |
| PRO1461 | lung tumor | universal normal control |
| PRO1461 | breast tumor | universal normal control |
| PRO1429 | colon tumor | universal normal control |
| PRO1429 | lung tumor | universal normal control |
| PRO1429 | breast tumor | universal normal control |
| PRO1568 | lung tumor | universal normal control |
| PRO1568 | breast tumor | universal normal control |
| PRO1569 | colon tumor | universal normal control |
| PRO1569 | lung tumor | universal normal control |
| PRO1569 | breast tumor | universal normal control |
| PRO1753 | colon tumor | universal normal control |
| PRO1753 | lung tumor | universal normal control |
| PRO1570 | colon tumor | universal normal control |
| PRO1570 | lung tumor | universal normal control |
| PRO1570 | breast tumor | universal normal control |
| PRO1570 | prostate tumor | universal normal control |
| PRO1570 | rectal tumor | universal normal control |
| PRO1559 | colon tumor | universal normal control |
| PRO1559 | lung tumor | universal normal control |
| PRO1559 | breast tumor | universal normal control |
| PRO1486 | lung tumor | universal normal control |
| PRO1486 | breast tumor | universal normal control |
| PRO1433 | colon tumor | universal normal control |
| PRO1433 | lung tumor | universal normal control |
| PRO1433 | breast tumor | universal normal control |
| PRO1433 | rectal tumor | universal normal control |
| PRO1490 | lung tumor | universal normal control |
| PRO1490 | breast tumor | universal normal control |
| PRO1482 | lung tumor | universal normal control |
| PRO1482 | breast tumor | universal normal control |
| PRO1409 | colon tumor | universal normal control |
| PRO1409 | lung tumor | universal normal control |
| PRO1409 | breast tumor | universal normal control |
| PRO1446 | colon tumor | universal normal control |
| PRO1446 | lung tumor | universal normal control |
| PRO1446 | breast tumor | universal normal control |
| PRO1446 | prostate tumor | universal normal control |
| PRO1604 | colon tumor | universal normal control |
| PRO1604 | lung tumor | universal normal control |
| PRO1604 | breast tumor | universal normal control |
| PRO1491 | colon tumor | universal normal control |
| PRO1491 | lung tumor | universal normal control |
| PRO1491 | breast tumor | universal normal control |
| PRO1431 | colon tumor | universal normal control |
| PRO1431 | lung tumor | universal normal control |
| PRO1563 | colon tumor | universal normal control |
| PRO1563 | lung tumor | universal normal control |
| PRO1563 | breast tumor | universal normal control |
| PRO1571 | colon tumor | universal normal control |
| PRO1571 | lung tumor | universal normal control |
| PRO1571 | breast tumor | universal normal control |
| PRO1572 | lung tumor | universal normal control |
| PRO1572 | prostate tumor | universal normal control |
| PRO1573 | lung tumor | universal normal control |
| PRO1573 | breast tumor | universal normal control |
| PRO1508 | lung tumor | universal normal control |
| PRO1508 | breast tumor | universal normal control |
| PRO1485 | colon tumor | universal normal control |
| PRO1485 | lung tumor | universal normal control |
| PRO1564 | colon tumor | universal normal control |
| PRO1564 | lung tumor | universal normal control |
| PRO1564 | breast tumor | universal normal control |
| PRO1550 | colon tumor | universal normal control |
| PRO1550 | lung tumor | universal normal control |
| PRO1550 | breast tumor | universal normal control |
| PRO1757 | lung tumor | universal normal control |
| PRO1757 | breast tumor | universal normal control |
| PRO1757 | prostate tumor | universal normal control |
| PRO1758 | lung tumor | universal normal control |
| PRO1781 | colon tumor | universal normal control |
| PRO1781 | lung tumor | universal normal control |
| PRO1781 | breast tumor | universal normal control |
| PRO1606 | lung tumor | universal normal control |
| PRO1606 | breast tumor | universal normal control |
| PRO1784 | colon tumor | universal normal control |
| PRO1784 | lung tumor | universal normal control |
| PRO1784 | breast tumor | universal normal control |
| PRO1774 | colon tumor | universal normal control |
| PRO1774 | lung tumor | universal normal control |
| PRO1774 | breast tumor | universal normal control |
| PRO1605 | colon tumor | universal normal control |
| PRO1605 | lung tumor | universal normal control |
| PRO1605 | prostate tumor | universal normal control |
| PRO1928 | colon tumor | universal normal control |
| PRO1928 | lung tumor | universal normal control |
| PRO1928 | cervical tumor | universal normal control |
| PRO1865 | lung tumor | universal normal control |
| PRO1865 | liver tumor | universal normal control |
| PRO1925 | lung tumor | universal normal control |
| PRO1926 | liver tumor | universal normal control |
| PRO2630 | colon tumor | universal normal control |
| PRO2630 | lung tumor | universal normal control |
| PRO2630 | breast tumor | universal normal control |
| PRO2630 | liver tumor | universal normal control |
| PRO3443 | colon tumor | universal normal control |
| PRO3443 | lung tumor | universal normal control |
| PRO3443 | breast tumor | universal normal control |
| PRO3301 | colon tumor | universal normal control |
| PRO3301 | lung tumor | universal normal control |
| PRO3301 | breast tumor | universal normal control |
| PRO3301 | rectal tumor | universal normal control |
| PRO3442 | colon tumor | universal normal control |
| PRO3442 | lung tumor | universal normal control |
| PRO3442 | rectal tumor | universal normal control |
| PRO4978 | colon tumor | universal normal control |
| PRO4978 | lung tumor | universal normal control |
| PRO4978 | breast tumor | universal normal control |
| PRO4978 | rectal tumor | universal normal control |
| PRO5801 | colon tumor | universal normal control |
| PRO5801 | breast tumor | universal normal control |
| PRO19630 | colon tumor | universal normal control |
| PRO203 | colon tumor | universal normal control |
| PRO204 | colon tumor | universal normal control |
| PRO204 | lung tumor | universal normal control |
| PRO204 | breast tumor | universal normal control |
| PRO204 | prostate tumor | universal normal control |
| PRO210 | colon tumor | universal normal control |
| PRO210 | lung tumor | universal normal control |
| PRO223 | lung tumor | universal normal control |
| PRO223 | breast tumor | universal normal control |
| PRO247 | colon tumor | universal normal control |
| PRO247 | lung tumor | universal normal control |

TABLE 8-continued

| Molecule | is overexpressed in: | as compared to: |
|---|---|---|
| PRO247 | breast | universal normal control |
| PRO358 | lung tumor | universal normal control |
| PRO358 | breast tumor | universal normal control |
| PRO358 | prostate tumor | universal normal control |
| PRO724 | lung tumor | universal normal control |
| PRO868 | colon tumor | universal normal control |
| PRO868 | lung tumor | universal normal control |
| PRO868 | prostate tumor | universal normal control |
| PRO868 | rectal tumor | universal normal control |
| PRO740 | colon tumor | universal normal control |
| PRO1478 | colon tumor | universal normal control |
| PRO1478 | lung tumor | universal normal control |
| PRO162 | colon tumor | universal normal control |
| PRO162 | lung tumor | universal normal control |
| PRO162 | breast tumor | universal normal control |
| PRO828 | colon tumor | universal normal control |
| PRO828 | lung tumor | universal normal control |
| PRO828 | breast tumor | universal normal control |
| PRO828 | cervical tumor | universal normal control |
| PRO828 | liver tumor | universal normal control |
| PRO819 | lung tumor | universal normal control |
| PRO819 | breast tumor | universal normal control |
| PRO819 | rectal tumor | universal normal control |
| PRO813 | colon tumor | universal normal control |
| PRO813 | lung tumor | universal normal control |
| PRO813 | breast tumor | universal normal control |
| PRO813 | prostate tumor | universal normal control |
| PRO1194 | colon tumor | universal normal control |
| PRO1194 | lung tumor | universal normal control |
| PRO1194 | breast tumor | universal normal control |
| PRO887 | colon tumor | universal normal control |
| PRO887 | lung tumor | universal normal control |
| PRO887 | rectal tumor | universal normal control |
| PRO1071 | colon tumor | universal normal control |
| PRO1071 | lung tumor | universal normal control |
| PRO1071 | breast tumor | universal normal control |
| PRO1029 | colon tumor | universal normal control |
| PRO1029 | lung tumor | universal normal control |
| PRO1029 | breast tumor | universal normal control |
| PRO1190 | lung tumor | universal normal control |
| PRO1190 | breast tumor | universal normal control |
| PRO4334 | lung tumor | universal normal control |
| PRO1155 | colon tumor | universal normal control |
| PRO1155 | lung tumor | universal normal control |
| PRO1157 | breast tumor | universal normal control |
| PRO1157 | cervical tumor | universal normal control |
| PRO1122 | lung tumor | universal normal control |
| PRO1122 | breast tumor | universal normal control |
| PRO1183 | colon tumor | universal normal control |
| PRO1183 | lung tumor | universal normal control |
| PRO1183 | breast tumor | universal normal control |
| PRO1337 | colon tumor | universal normal control |
| PRO1337 | lung tumor | universal normal control |
| PRO1337 | breast tumor | universal normal control |
| PRO1480 | colon tumor | universal normal control |
| PRO1480 | lung tumor | universal normal control |
| PRO1480 | breast tumor | universal normal control |
| PRO19645 | colon tumor | universal normal control |
| PRO9782 | colon tumor | universal normal control |
| PRO1419 | colon tumor | universal normal control |
| PRO1575 | colon tumor | universal normal control |
| PRO1575 | lung tumor | universal normal control |
| PRO1567 | colon tumor | universal normal control |
| PRO1567 | lung tumor | universal normal control |
| PRO1567 | breast tumor | universal normal control |
| PRO1891 | colon tumor | universal normal control |
| PRO1889 | colon tumor | universal normal control |
| PRO1889 | lung tumor | universal normal control |
| PRO1785 | lung tumor | universal normal control |
| PRO1785 | prostate tumor | universal normal control |
| PRO6003 | colon tumor | universal normal control |
| PRO4333 | colon tumor | universal normal control |
| PRO4356 | colon tumor | universal normal control |
| PRO4352 | colon tumor | universal normal control |
| PRO4354 | colon tumor | universal normal control |
| PRO4354 | lung tumor | universal normal control |
| PRO4354 | prostate tumor | universal normal control |

TABLE 8-continued

| Molecule | is overexpressed in: | as compared to: |
|---|---|---|
| PRO4369 | colon tumor | universal normal control |
| PRO6030 | colon tumor | universal normal control |
| PRO4433 | colon tumor | universal normal control |
| PRO4424 | colon tumor | universal normal control |
| PRO4424 | breast tumor | universal normal control |
| PRO6017 | colon tumor | universal normal control |
| PRO19563 | colon tumor | universal normal control |
| PRO6015 | colon tumor | universal normal control |
| PRO5779 | colon tumor | universal normal control |
| PRO5776 | colon tumor | universal normal control |
| PRO4430 | lung tumor | universal normal control |
| PRO4421 | colon tumor | universal normal control |
| PRO4499 | colon tumor | universal normal control |
| PRO4423 | colon tumor | universal normal control |
| PRO5998 | colon tumor | universal normal control |
| PRO5998 | lung tumor | universal normal control |
| PRO4501 | colon tumor | universal normal control |
| PRO6240 | colon tumor | universal normal control |
| PRO6245 | colon tumor | universal normal control |
| PRO6175 | colon tumor | universal normal control |
| PRO9742 | colon tumor | universal normal control |
| PRO7179 | colon tumor | universal normal control |
| PRO6239 | colon tumor | universal normal control |
| PRO6493 | colon tumor | universal normal control |
| PRO9741 | colon tumor | universal normal control |
| PRO9822 | colon tumor | universal normal control |
| PRO6244 | colon tumor | universal normal control |
| PRO9740 | colon tumor | universal normal control |
| PRO9739 | colon tumor | universal normal control |
| PRO7177 | colon tumor | universal normal control |
| PRO7178 | colon tumor | universal normal control |
| PRO6246 | colon tumor | universal normal control |
| PRO6241 | colon tumor | universal normal control |
| PRO9835 | colon tumor | universal normal control |
| PRO9857 | colon tumor | universal normal control |
| PRO7436 | colon tumor | universal normal control |
| PRO9856 | colon tumor | universal normal control |
| PRO19605 | colon tumor | universal normal control |
| PRO9859 | colon tumor | universal normal control |
| PRO12970 | colon tumor | universal normal control |
| PRO19626 | colon tumor | universal normal control |
| PRO9883 | colon tumor | universal normal control |
| PRO19670 | colon tumor | universal normal control |
| PRO19624 | colon tumor | universal normal control |
| PRO19680 | colon tumor | universal normal control |
| PRO19675 | colon tumor | universal normal control |
| PRO9834 | colon tumor | universal normal control |
| PRO9744 | colon tumor | universal normal control |
| PRO19644 | colon tumor | universal normal control |
| PRO19625 | colon tumor | universal normal control |
| PRO19597 | colon tumor | universal normal control |
| PRO16090 | colon tumor | universal normal control |
| PRO19576 | colon tumor | universal normal control |
| PRO19646 | colon tumor | universal normal control |
| PRO19814 | colon tumor | universal normal control |
| PRO19669 | colon tumor | universal normal control |
| PRO19818 | colon tumor | universal normal control |
| PRO20088 | colon tumor | universal normal control |
| PRO16089 | colon tumor | universal normal control |
| PRO20025 | colon tumor | universal normal control |
| PRO20040 | colon tumor | universal normal control |
| PRO1760 | adrenal tumor | universal normal control |
| PRO1760 | breast tumor | universal normal control |
| PRO1760 | cervical tumor | universal normal control |
| PRO1760 | colon tumor | universal normal control |
| PRO1760 | liver tumor | universal normal control |
| PRO1760 | lung tumor | universal normal control |
| PRO1760 | prostate tumor | universal normal control |
| PRO1760 | rectal tumor | universal normal control |
| PRO6029 | adrenal tumor | universal normal control |
| PRO6029 | colon tumor | universal normal control |
| PRO6029 | prostate tumor | universal normal control |
| PRO1801 | colon tumor | universal normal control |
| PRO1801 | lung tumor | universal normal control |

SEQUENCE LISTING (612 sequences)

SEQ ID NO: 1 - DNA, 3033 bp, Homo Sapien
gaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcacttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctaatctgctggcattgagctggggctgggtcaccaaacccttcccaaaaggaccttatctctttcttgcacacatgcctctctcccacttttcccaacccccacatttgcaactagaaaaagttgcccataaaattgctctgcccttgacaggttctgttatttattgacttttgccaaggctggtcacaacaatcatattcacgttattttccccttttggtggcagaactgttaccaatagggggagaagacagccacggatgaagcgtttctcagcttttggaattgcttcgactgacatccgttgttaaccgtttgccactcttcagatattttttataaaaaaagtaccactgagttcatgagggccacagattggttattaatgagatacgagggttggtgctgggtgtttgtttcctgagctaagtgatcaagactgtagtggagttgcagctaacatgggttaggtttaaaccatgggggatgcacccctttgcgtttcatatgtagccctactggctttgtgtagctggagtagttgggttgctttgtgttaggaggatccagatcatgttggctacagggagatgctctctttgagaggtcctgggcattgattcccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacttctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatatttctgacagtgagtgacccggagtctctggtgtaccctcttaccagtcagctgcctgcgagcagtcattttttcctaaaggtttacaagtatttagaacttttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttg

SEQ ID NO: 2 - protein, 251 aa, Homo Sapien
MSDIGDWFRSIPAITRYWFAATVAVPLVGKLGLISPAYLFLWPEAFLYRFQIWRPITATFYFPVGPGTGFLYLVNLYFLYQYSTRLETGAFDGRPADYLFMLLFNWICIVITGLAMDMQLLMIPLIMSVLYVWAQLNRDMIVSFWFGTRFKACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 3 - DNA, 1351 bp, Homo Sapien
gagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtacgctggtgagactgttcaggaaagaaaacagaaggatcgaaaggcactccatgagctaaaactggaagagtggaaaggcagactacaagttactgagcacctccctgagaaaattgaaagtagtttacgggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatggatatatccacccacctagattttaagcagtaaataaaacatttcgcaaaagattaaagttgaattttacagttt

SEQ ID NO: 4 - protein, 285 aa, Homo Sapien [sequence omitted]

SEQ ID NO: 5 - DNA, 1487 bp, Homo Sapien
cggacgcgtgggcgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccagctacctgggaggctgaggcaggagaatcgcttgaacccggggggcagaggttgcagtgagctgagtttgcgccactgcactctagcctgggggagaaagtgaaactccctctcaaaaaaaagaccactctcagtatctctgatttctgaagatgtacaaaaaaatatagcttcatatatctggaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaa

SEQ ID NO: 6 - protein, 158 aa, Homo Sapien
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVWLFIGFMLMFGSLIASMWILFGAYVTQNTDVYPGLAVFFQNALIFFSTLIYKFGRTEELWT

SEQ ID NO: 7 - DNA, 2886 bp, Homo Sapien
gcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagtgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaggggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaacct

SEQ ID NO: 8 - protein, 424 aa, Homo Sapien
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRSECPRKDNCTAKEWTFPEAKWNTTARVFSHIRLGMGHVLIIVQCFISSMANIYNEKILKEGNQLTESIFIQNSKLYFFGILFNGLTLGLQRSNRDQIKNCGFFYGHSAFSVALIFVTAFQGLSVAFILKFLDNMFHVLMAQVTTVIITTVSVLVFDFRPSLEFFLEAPSVLLSIFIYNASKPQVPEYAPRQERIRDLSGNLWERSSGDGEELERLTKPKSDESDEDTF

SEQ ID NO: 9 - DNA, 1173 bp, Homo Sapien
ggggcttcggcgccagcggccagcgctagtcggtctggtaaggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatg

SEQ ID NO: 10 - protein, 266 aa, Homo Sapien
MWWFQQGLSFLPSALVIWTSAAFIFSYITAVTLHHIDPALPYISDTGTVAPEKCLFGAMLNIAAVLCIATIYVRYKQVHALSPEENVIIKLNKAGLVLGILSCLGLSIVANFQKTTLFAAHVSGAVLTFGMGSLYMFVQTILSYQMQPKIHGKQVFWIRLLLVIWCGVSALSMLTCSSVLHSGNFGTDLEQKLHWNPEDKGYVLHMITTAAEWSMSFSFFGFFLTYIRDFQKISLRVEANLHGLTLYDTAPCPINNERTRLLSRDI

SEQ ID NO: 11 - DNA, 1399 bp, Homo Sapien
cccacgcgtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctgaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtggaggagaacagaaacagcttgttttttttcttattgtttttgagacttttccccatgacaccaaactggttcttgaacctctcggccccaattctgaacattcccatcgtgcagttcttcttctcagttcttatcggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgac

SEQ ID NO: 12 - protein, 264 aa, Homo Sapien
MRPLLGLLLVFAGCTFALYLLSTRLPRGRRLGSTEEAGGRSLWFPSDLAELRELSEVLREYRKEHQAYVFLLFCGAYLYKQGFAIPGSSFLNVLAGALFGPWLGLLLCCVLTSVGATCCYLLSSIFGKQLVVSYFPDKVALLQRKVEENRNSLFFFLLFLRLFPMTPNWFLNLSAPILNIPIVQFFFSVLIGLIPYNFICVQTGSILSTLTSLDALFSWDTVFKLLAIAMVALIPGTLIKKFSQKHLQLNETSTANHIHSRKDT

SEQ ID NO: 13 - DNA, 2037 bp, Homo Sapien
cggacgcgtgggcggacgcgtgggggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacaaaaaaaaaaaaaaaaaaaaagggcggccgcgactctagagtcgacctgcagaagcttggccgccatggcccaacttgtttattgcagcttataatg

SEQ ID NO: 14 - protein, 455 aa, Homo Sapien
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 15 - DNA, 2362 bp, Homo Sapien
gacggaagaacagcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaaggctttaccttgtgggggtcagaatattcgtggaactggaatgccatagatgaggggcccaagagggacattgtcaaggaacttgaggtagccattaggaacagaactgacctgcgttttggactgtactattccctttttgaatggtttcatccgctcttccttgaggatgaatccagttcattccataagcggcaatttccagtttctaagacattgccagagctctatgagttagtgaacaactatcagcctgaggttctgtggtcggatggtgacggaggagcaccggatcaatactggaacagcacaggcttcttggcctggttatataatgaaagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaagcaacttgtagagacagtttcatgtggaggaaatcttttgatgaatattgggcccacactagatggcaccatttctgtagtttttgaggagcgactgaggcaagtggggtcctggctaaaagtcaatggagaagctatttatgaaacctatacctggcgatcccagaatgacactgtcaccccagatgtgtggtacacatccaagcctaaagaaaaattagtctatgccatttttcttaaatggcccacatcaggacagctgttccttggccatcccaaagctattctgggggcaacagaggtgaaactactgggccatggacagccacttaactggatttctttggagcaaaatggcattatggtagaactgccacagctaaccattcatcagatgccgtgtaaatggggctgggctctagccctaactaatgtgatctaaagtgcagcagagtggctgatgctgcaagttatgtctaaggctaggaactatcaggtgtctataattgtagcacatggagaaagcaatgtaaactggataagaaaattatttggcagttcagccctttccctttttcccactaaatttttcttaaattacccatgtaaccattttaactctccagtgcactttgccattaaagtctcttcacattgatttgtttccatgtgtgactcagaggtgagaattttttcacattatagtagcaaggaattggtggtattatggaccgaactgaaaattttatgttgaagccatatcccccatgattatatagttatgcatcacttaatatggggatattttctgggaaatgcattgctagtcaatttttttttgtgccaacatcatagagtgtatttacaaaatcctagatggcatagcctactacacacctaatgtgtatggtatagactgttgctcctaggctacagacatatacagcatgttactgaatactgtaggcaatagtaacagtggtatttgtatatcgaaacatatggaaacatagagaaggtacagtaaaaatactgtaaaataaatggtgcacctgtatagggcacttaccacgaatggagcttacaggactggaagttgctctgggtgagtcagtgagtgaatgtgaaggcctaggacattattgaacactgccagacgttataaatactgtatgcttaggctacactacatttataaaaaaaagtttttctttcttcaattataaattaacataagtgtactgtaactttacaaacgttttaatttttaaaacctttttggctcttttgtaataacacttagcttaaaacataaactcattgtgcaaatgtaa

SEQ ID NO: 16 - protein, 467 aa, Homo Sapien
MRPQELPRLAFPLLLLLLLLLPPPPCPAHSATRFDPTWESLDARQLPAWFDQAKFGIFIHWGVFSVPSFGSEWFWWYWQKEKIPKYVEFMKDNYPPSFKYEDFGPLFTAKFFNANQWADIFQASGAKYIVLTSKHHEGFTLWGSEYSWNWNAIDEGPKRDIVKELEVAIRNRTDLRFGLYYSLFEWFHPLFLEDESSSFHKRQFPVSKTLPELYELVNNYQPEVLWSDGDGGAPDQYWNSTGFLAWLYNESPVRGTVVTNDRWGAGSICKHGGFYTCSDRYNPGHLLPHKWENCMTIDKLSWGYRREAGISDYLTIEELVKQLVETVSCGGNLLMNIGPTLDGTISVVFEERLRQVGSWLKVNGEAIYETYTWRSQNDTVTPDVWYTSKPKEKLVYAIFLKWPTSGQLFLGHPKAILGATEVKLLGHGQPLNWISLEQNGIMVELPQLTIHQMPCKWGWALALTNVI

SEQ ID NO: 17 - DNA, 1771 bp, Homo Sapien
cccacgcgtccgctggtgttagatcgagcaaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 18 - protein, 300 aa, Homo Sapien
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKVKAEIGDVSILVNNAGVVYTSDLFATQDPQIEKTFEVNVLAHFWTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 19 - DNA, 1815 bp, Homo Sapien
cccacgcgtccgctccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgcctcggatttggacctcagaggagggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccgtcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggttggcctgtgcatcggcaattctcatatctgtttttttcaaagaataaaatcaaataaagagcaggaaaaaaaaa

SEQ ID NO: 20 - protein, 382 aa, Homo Sapien
MRPGTALQAVLLAVLLVGLRAATGRLLSASDLDLRGGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 21 - DNA, 3106 bp, Homo Sapien
  unsure 1683: unknown base
aggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggctggactggagcaccctggtccctctgcggctccgccatcgacagctggggctgcaggccaagggctggaacttcatgctggaggattccaccttctggatcttcgggggctccatccactatttccgtgtgcccagggagtactggagggaccgcctgctgaagatgaaggcctgtggcttgaacaccctcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttggccaccatcaacttgcagtcaacacacgagctgcagctactgaccacctttctcttcaacgtccaggggactcagcccaagatggtgatggagtactggacggggtggtttgactcgtggggaggccctcacaatatcttggattcttctgaggttttgaaaaccgtgtctgccattgtggacgccggctcctccatcaacctctacatgttccacggaggcaccaactttggcttcatgaatggagccatgcacttccatgactacaagtcagatgtcaccagctatgactatgatgctgtgctgacagaagccggcgattacacggccaagtacatgaagcttcgagacttcttcggctccatctcaggcatccctctccctcccccacctgaccttcttcccaagatgccgtatgagcccttaacgccagtcttgtacctgtctctgtgggacgccctcaagtacctgggggagccaatcaagtctgaaaagcccatcaacatggagaacctgccagtcaatgggggaaatggacagtccttcgggtacattctctatgagaccagcatcacctcgtctggcatcctcagtggccacgtgcatgatcgggggcaggtgtttgtgaacacagtatccataggattcttggactacaagacaacgaagattgctgtccccctgatccagggttacaccgtgctgaggatcttggtggagaatcgtgggcgagtcaactatggggagaatattgatgaccagcgcaaaggcttaattggaaatctctatctgaatgattcacccctgaaaaacttcagaatctatagcctggatatgaagaagagcttctttcagaggttcggcctggacaaatggngttccctcccagaaacacccacattacctgctttcttcttgggtagcttgtccatcagctccacgccttgtgacacctttctgaagctggagggctgggagaagggggttgtattcatcaatggccagaaccttggacgttactggaacattggaccccagaagacgctttacctcccaggtccctggttgagcagcggaatcaaccaggtcatcgtttttgaggagacgatggcgggccctgcattacagttcacggaaaccccccacctgggcaggaaccagtacattaagtgagcggtggcaccccctcctgctggtgccagtgggagactgccgcctcctcttgacctgaagcctggtggctgctgccccacccctcactgcaaaagcatctccttaagtagcaacctcagggactgggggctacagtctgcccctgtctcagctcaaaaccctaagcctgcagggaaaggtgggatggctctgggcctggctttgttgatgatggctttcctacagccctgctcttgtgccgaggctgtcgggctgtctctagggtgggagcagctaatcagatcgcccagcctttggccctcagaaaaagtgctgaaacgtgcccttgcaccggacgtcacagccctgcgagcatctgctggactcaggcgtgctctttgctggttcctgggaggcttggccacatccctcatggccccattttatccccgaaatcctgggtgtgtcaccagtgtagagggtggggaaggggtgtctcacctgagctgactttgttcttccttcacaaccttctgagccttctttgggattctggaaggaactcggcgtgagaaacatgtgacttcccctttcccttcccactcgctgcttcccacagggtgacaggctgggctggagaaacagaaatcctcaccctgcgtcttcccaagttagcaggtgtctctggtgttcagtgaggaggacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcacatgtgagtcctggcagaagccatggcccatgtctgcacatccagggaggaggacagaaggcccagctcagtggcccccgctccccaccccccacgcccgaacagcaggggcagagcagccctccttcgaagtgtgtccaagtccgcatttgagccttgttctggggcccagcccaacacctggcttgggctcactgtcctgagttgcagtaaagctataaccttgaatcacaa

SEQ ID NO: 22 - protein, 636 aa, Homo Sapien
  unsure 539: unknown amino acid
MTTWSLRRRPARTLGLLLLVVLGFLVLRRLDWSTLVPLRLRHRQLGLQAKGWNFMLEDSTFWIFGGSIHYFRVPREYWRDRLLKMKACGLNTLTTYVPWNLHEPERGKFDFSGNLDLEAFVLMAAEIGLWVILRPGPYICSEMDLGGLPSWLLQDPGMRLRTTYKGFTEAVDLYFDHLMSRVVPLQYKRGGPIIAVQVENEYGSYNKDPAYMPYVKKALEDRGIVELLLTSDNKDGLSKGIVQGVLATINLQSTHELQLLTTFLFNVQGTQPKMVMEYWTGWFDSWGGPHNILDSSEVLKTVSAIVDAGSSINLYMFHGGTNFGFMNGAMHFHDYKSDVTSYDYDAVLTEAGDYTAKYMKLRDFFGSISGIPLPPPPDLLPKMPYEPLTPVLYLSLWDALKYLGEPIKSEKPINMENLPVNGGNGQSFGYILYETSITSSGILSGHVHDRGQVFVNTVSIGFLDYKTTKIAVPLIQGYTVLRILVENRGRVNYGENIDDQRKGLIGNLYLNDSPLKNFRIYSLDMKKSFFQRFGLDKWXSLPETPTLPAFFLGSLSISSTPCDTFLKLEGWEKGVVFINGQNLGRYWNIGPQKTLYLPGPWLSSGINQVIVFEETMAGPALQFTETPHLGRNQYIK

SEQ ID NO: 23 - DNA, 997 bp, Homo Sapien
cccacgcgtccgatcttaccaacaaaacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggttcagtcaagaattgttgtccattgaactgggaatattttcaatccagctgctacttcttttctactgacaccatttcctgggcgttaagtttaaagaactgctcagccatgggggctcacctggtggttatcaactcacaggaggagcaggaattcctttcctacaagaaacctaaaatgagagagttttttattggactgtcagaccaggttgtcgagggtcagtggcaatgggtggacggcacacctttgacaaagtctctgagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacccaccgccccacacgagaaatttgtgcgctgaacttcaaaggacttcataagtatttgttactctgatacaaataaaaataagtagttttaaatgttaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24 - protein, 219 aa, Homo Sapien
MNSSKSSETQCTERGCFSSQMFLWTVAGIPILFLSACFITRCVVTFRIFQTCDEKKFQLPENFTELSCYNYGSGSVKNCCPLNWEYFQSSCYFFSTDTISWALSLKNCSAMGAHLVVINSQEEQEFLSYKKPKMREFFIGLSDQVVEGQWQWVDGTPLTKSLSFWDVGEPNNIATLEDCATMRDSSNPRQNWNDVTCFLNYFRICEMVGINPLNKGKSL

SEQ ID NO: 25 - DNA, 2505 bp, Homo Sapien
ggggacgcggagctgagaggctccgggctagctaggtgtaggggtggacgggtcccaggaccctggtgagggttctctacttggccttcggtgggggtcaagacgcaggcacctacgccaaaggggagcaaagccgggctcggcccgaggcccccaggacctccatctcccaatgttggaggaatccgacacgtgacggtctgtccgccgtctcagactagaggagcgctgtaaacgccatggctcccaagaagctgtcctgccttcgttccctgctgctgccgctcagcctgacgctactgctgccccaggcagacactcggtcgttcgtagtggataggggtcatgaccggtttctcctagacggggccccgttccgctatgtgtctggcagcctgcactactttcgggtaccgcgggtgctttgggccgaccggcttttgaagatgcgatggagcggcctcaacgccatacagttttatgtgccctggaactaccacgagccacagcctggggtctataactttaatggcagccgggacctcattgcctttctgaatgaggcagctctagcgaacctgttggtcatactgagaccaggaccttacatctgtgcagagtgggagatggggggtctcccatcctggttgcttcgaaaacctgaaattcatctaagaacctcagatccagacttccttgccgcagtggactcctggttcaaggtcttgctgcccaagatatatccatggctttatcacaatgggggcaacatcattagcattcaggtggagaatgaatatggtagctacagagcctgtgacttcagctacatgaggcacttggctgggctcttccgtgcactgctaggagaaaagatcttgctcttcaccacagatgggcctgaaggactcaagtgtggctccctccggggactctataccactgtagattttggcccagctgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttggatattggaatggtgccgataagaagggacgcttccttccgattactaccagctatgactatgatgcacctatatctgaagcaggggaccccacacctaagctttttgctcttcgagatgtcatcagcaagttccaggaagttcctttgggacctttacctcccccgagccccaagatgatgcttggacctgtgactctgcacctggttgggcatttactggctttcctagacttgctttgcccccgtgggcccattcattcaatcttgccaatgacctttgaggctgtcaagcaggaccatggcttcatgttgtaccgaacctatatgacccataccatttttgagccaacaccattctgggtgccaaataatggagtccatgaccgtgcctatgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccgggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctcaaaaaaaaaaaa

SEQ ID NO: 26 - protein, 654 aa, Homo Sapien
MAPKKLSCLRSLLLPLSLTLLLPQADTRSFVVDRGHDRFLLDGAPFRYVSGSLHYFRVPRVLWADRLLKMRWSGLNAIQFYVPWNYHEPQPGVYNFNGSRDLIAFLNEAALANLLVILRPGPYICAEWEMGGLPSWLLRKPEIHLRTSDPDFLAAVDSWFKVLLPKIYPWLYHNGGNIISIQVENEYGSYRACDFSYMRHLAGLFRALLGEKILLFTTDGPEGLKCGSLRGLYTTVDFGPADNMTKIFTLLRKYEPHGPLVNSEYYTGWLDYWGQNHSTRSVSAVTKGLENMLKLGASVNMYMFHGGTNFGYWNGADKKGRFLPITTSYDYDAPISEAGDPTPKLFALRDVISKFQEVPLGPLPPPSPKMMLGPVTLHLVGHLLAFLDLLCPRGPIHSILPMTFEAVKQDHGFMLYRTYMTHTIFEPTPFWVPNNGVHDRAYVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 27 - DNA, 1985 bp, Homo Sapien
ggacagctcgcggcccccgagagctctagccgtcgaggagctgcctggggacgtttgccctggggccccagcctggcccgggtcaccctggcatgaggagatgggcctgttgctcctggtcccattgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgctacggtgcagtaccccatcatgttgccccggcagccctgcggtggcccaggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggcagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaatctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28 - protein, 360 aa, Homo Sapien
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 29 - DNA, 2397 bp, Homo Sapien
gcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacgtgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccatacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattaaagagtttggatgtgtaacttgtgatgccttagaaaaatatcctaagcacaaaataaacctttctaaccacttcattaaagctgaaaaaaaaaaaaaaaaaa

SEQ ID NO: 30 - protein, 280 aa, Homo Sapien
MAPSGSLAVPLAVLVLLLWGAPWTHGRRSNVRVITDENWRELLEGDWMIEFYAPWCPACQNLQPEWESFAEWGEDLEVNIAKVDVTEQPGLSGRFIITALPTIYHCKDGEFRRYQGPRTKKDFINFISDKEWKSIEPVSSWFGPGSVLMSSMSALFQLSMWIRTCHNYFIEDLGLPVWGSYTVFALATLFSGLLLGLCMIFVADCLCPSKRRRPQPYPYPSKKLLSESAQPLKKVEEEQEADEEDVSEEEAESKEGTNKDFPQNAIRQRSLGPSLATDKS

SEQ ID NO: 31 - DNA, 1620 bp, Homo Sapien
  unsure 973, 977, 996, 1003: unknown base
agatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagcctttnattnatgttttccctttggctgngactggntggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttg

SEQ ID NO: 32 - protein, 296 aa, Homo Sapien
MAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 33 - DNA, 1413 bp, Homo Sapien
cggacgcgtggggtgcccgacatggcgagtgtagtgctgccgagcggatcccagtgtgcggcggcagcggcggcggcggcgcctcccgggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattgg

SEQ ID NO: 34 - protein, 440 aa, Homo Sapien
MASVVLPSGSQCAAAAAAAAPPGLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 35 - DNA, 2690 bp, Homo Sapien
  unsure 2039-2065: unknown base
ggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtgtttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtannnnnnnnnnnnnnnnnnnnnnnnnnnttgtttttccttttgactcctgctcccattaggagcaggaatggcagtaataaaagtctgcactttggtcatttcttttcctcagaggaagcccgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgca

SEQ ID NO: 36 - protein, 364 aa, Homo Sapien
MSVMVVRKKVTRKWEKLPGRNTFCCDGRVMMARQKGIFYLTLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVERFDHHCPWVGNCVGKRNYRYFYLFILSLSLLTIYVFAFNIVYVALKSLKIGFLETLKETPGTVLEVLICFFTLWSVVGLTGFHTFLVALNQTTNEDIKGSWTGKNRVQNPYSHGNIVKNCCEVLCGPLPPSVLDRRGILPLEESGSRPPSTQETSSSLLPQSPAPTEHLNSNEMPEDSSTPEEMPPPEPPEPPQEAAEAEK

SEQ ID NO: 37 - DNA, 3231 bp, Homo Sapien
ggcggagcagccctagccgccaccgtcgctctcgcagctctcgtcgccactgccaccgccgccgccgtcactgcgtcctggctccggctcccgcgccctcccggccggccatgcagccccgccgcgcccaggcgcccggtgcgcagctgctgcccgcgctggccctgctgctgctgctgctcggagcggggccccgaggcagctccctggccaacccggtgcccgccgcgcccttgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctacctggcagccgaaaacagggcagaaagttgtagaaatgaaatgggatcaagtggaggtgatcccagatattgcctgtgggaatgccagttctaacagctctgcgggtggccgcctggtatcctttgaagtgccacagaacacctcagtcaagattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaatctttttttggattatttttcaaaaagatgagatactacactcatttaaatatttttaagaaaataaaaagcttaagaaatttaaaatgctagctgctcaagagttttcagtagaatatttaagaactaattttctgcagcttttagtttggaaaaaatattttaaaaacaaaatttgtgaaacctatagacgatgttttaatgtaccttcagctctctaaactgtgtgcttctactagtgtgtgctcttttcactgtagacactatcacgagacccagattaatttctgtggttgttacagaataagtctaatcaaggagaagtttctgtttgacgtttgagtgccggctttctgagtagagttaggaaaaccacgtaacgtagcatatgatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtgagtaaattaaatttacatttgagttgtttgttgctaagaggtagtaaatgtaagagagtactggttccttcagtagtgagtatttctcatagtgcagctttatttatctccaggatgtttttgtggctgtatttgattgatatgtgcttcttctgattcttgctaatttccaaccatattgaataaatgtgatcaagtca

SEQ ID NO: 38 - protein, 737 aa, Homo Sapien
MQPRRAQAPGAQLLPALALLLLLLGAGPRGSSLANPVPAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTWQPKTGQKVVEMKWDQVEVIPDIACGNASSNSSAGGRLVSFEVPQNTSVKIRQDATASLILLWKVTATGFQQCSLIDGRSVTPLQASGGLVLLEEMLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 39 - DNA, 1819 bp, Homo Sapien
gagccgccgccgcgcgcgcgccgcgcactgcagccccaggccccggccccccacccacgtctgcgttgctgccccgcctgggccaggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagttttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagattgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaatttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaag

SEQ ID NO: 40 - protein, 204 aa, Homo Sapien
MVCGGFACSKNCLCALNLLYTLVSLLLIGIAAWGIGFGLISSLRVVGVVIAVGIFLFLIALVGLIGAVKHHQVLLFFYMIILLLVFIVQFSVSCACLALNQEQQGQLLEVGWNNTASARNDIQRNLNCCGFRSVNPNDTCLASCVKSDHSCSPCAPIIGEYAGEVLRFVGGIGLFFSFTEILGVWLTYRYRNQKDPRANPSAFL

SEQ ID NO: 41 - DNA, 2061 bp, Homo Sapien
cagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccagaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctggttgtttgtagcctaa

SEQ ID NO: 42 - protein, 359 aa, Homo Sapien
MKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHQKPGTTKATAE

SEQ ID NO: 43 - DNA, 2168 bp, Homo Sapien
gcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaaaaaaaaaa

SEQ ID NO: 44 - protein, 533 aa, Homo Sapien
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 45 - DNA, 2403 bp, Homo Sapien
ggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcacgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaaaaaaaaa

SEQ ID NO: 46 - protein, 550 aa, Homo Sapien
MSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 47 - DNA, 1901 bp, Homo Sapien
gccccgcgcccggcgccgggcgcccgaagccgggagccaccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtaaaaaaaa

SEQ ID NO: 48 - protein, 457 aa, Homo Sapien
MGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 49 - DNA, 1638 bp, Homo Sapien
gccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaaaaaaaaaaaaaaa

SEQ ID NO: 50 - protein, 383 aa, Homo Sapien
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 51 - DNA, 3003 bp, Homo Sapien
gggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcacctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacgtacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcagtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgaatcacaaagatgattaaagggttggaaaaaaagatctatgatggaaaattaaaggaactgggattattgagcctggagaagagaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcctactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatggcaatcctagcagtattaaagaaaaaaggaaactatttattccaaatgagagtatgatggacagatattttagtatctcagtaatgtcctagtgtggcggtggttttcaatgtttcttcatggtaaaggtataagcctttcatttgttcaatggatgatgtttcagatttttttttttttaagagatccttcaaggaacacagttcagagagattttcatcgggtgcattctctctgcttcgtgtgtgacaagttatcttggctgctgagaaagagtgccctgccccacaccggcagacctttccttcacctcatcagtatgattcagtttctcttatcaattggactctcccaggttccacagaacagtaatattttttgaacaataggtacaatagaaggtcttctgtcatttaacctggtaaaggcagggctggagggggaaaataaatcattaagcctttgagtaacggcagaatatatggctgtagatccatttttaatggttcatttcctttatggtcatataactgcacagctgaagatgaaaggggaaaataaatgaaaattttacttttcgatgccaatgatacattgcactaaactgatggaagaagttatccaaagtactgtataacatcttgtttattatttaatgttttctaaaataaaaaatgttagtggttttccaaatggcctaataaaaacaattatttgtaaataaaaacactgttagtaat

SEQ ID NO: 52 - protein, 509 aa, Homo Sapien
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLHLAPDGRTCVDVDECATGRASCPRFRQCVNTFGSYICKCHKGFDLMYIGGKYQCHDIDECSLGQYQCSSFARCYNVRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSESQR

SEQ ID NO: 53 - DNA, 1998 bp, Homo Sapien
cgggccgcccccggcccccattcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacrgctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctccctgccccaagtgaagacagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaaaaaaaaaaaaaaaaaaa

SEQ ID NO: 54 - protein, 316 aa, Homo Sapien
  unsure 233: unknown amino acid
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSVLRVVLGANGTYSCLVRNPVLQQDAHXSVTITGQPMTFPPEALWVTVGLSVCLIALLVALAFVCWRKIKQSCEEENAGAEDQDGEGEGSKTALQPLKHSDSKEDDGQEIA

SEQ ID NO: 55 - DNA, 1892 bp, Homo Sapien
gagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgactcccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccattttttattaaataaaatgcttattttaggaaa

SEQ ID NO: 56 - protein, 566 aa, Homo Sapien [sequence omitted]

SEQ ID NO: 57 - DNA, 2456 bp, Homo Sapien
cgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggtgccttgcacaccaagaggcctcaagtggtcaccaaatatggaaccctgcaaggaaaacagatgcatgtggggaagacacccatccaagtctttttaggagtccccttctccagacctcctctaggtatcctcaggtttgcacctccagaacccccggagccctggaaaggaatcagagatgctaccacctacccgcctggatggagtctcgctctgtcgccaggctggagtgcagtggcacgatctcggctcactgcaacctccgcctcccgggttcaagcgagtctcctgcctcagcctctgagtgtctggggctacaggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgagcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttataatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgttcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattagaaaaaaaaaaa

SEQ ID NO: 58 - protein, 545 aa, Homo Sapien
MSTGFSFGSGTLGSTTVAAGGTSTGGVFSFGTGTSSNPSVGLNFGNLGSTSTPATTSAPSSGFGTGLFGSKPATGFTLGGTNTGALHTKRPQVVTKYGTLQGKQMHVGKTPIQVFLGVPFSRPPLGILRFAPPEPPEPWKGIRDATTYPPGWSLALSPGWSAVARSRLTATSASRVQASLLPQPLSVWGYRCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYNITKEQVPLVVEEYLDNVNEHDWKMLRNRMMDIVQDATFVYATLQTAHYHRETPMMGICPAGHATTRMKSTCSWILPQEWA

SEQ ID NO: 59 - DNA, 2331 bp, Homo Sapien
cggacgcgtgggctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccaaactccgtcaaaaaaaaacaaaacaaaacaaaaaaaagacatgggagagatggtgtttttcctctccaccacctggggatacgatgagaagatggccacctgcaagccaggaagacggccctcaccagacaccatgtctgctggcaccttgatcttggacctcccagcctccagaactgtgagaaataaatgtgttttgtttaagctaaaaaaaaaaaaaaaaaaaaaaaaaaaaaaaaaaaaaaaaaaaaaaaaaaaaaaa

SEQ ID NO: 60 - protein, 694 aa, Homo Sapien
MLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPNSVKKKQNKTKKRHGRDGVFPLHHLGIR

SEQ ID NO: 61 - DNA, 3089 bp, Homo Sapien
caggaaccctctctttgggtctggattgggacccctttccagtaccattttttctagtgaaccacgaagggacgataccagaaaacaccctcaacccaaaggaaatagactacagccccaattggctgactttggctatagaaaaaagaaaggaacgaaaagagacagttttttttggaaagctaagtcttccctttatcgagtcaagaaacccccccttcttgagctatttacagcttttaacaattgagtaaagtacgctccggtcaccatggtgacagccgccctgggtcccgtctgggcagcgctcctgctctttctcctgatgtgtgagatccgtatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcaggtgctggtcccgtcccctgcagggctcagtttgcactgctgtgaagcaggaaggccagggaggtccccggggacctggcattctggggagaccctgcttctatcttggctgccatcatccctcccagcctatttctgctcctctcttctctcttggacctattttaagaagcttgctaacctaaatattctagaactttcccagcctcgtagcccagcacttctcaaacttggaaatgcatgcgaatcacccggggttcgtgttaaatgcagattctgactcagcaggtctgagtgggtccaggattctgtgtttctcatatgttcctgggtgatgctgatggggtcagtctatgaaccacactggagcaaccaggttctaggactttctcaatattctagtactttctgaacattctggaatcctccccacattctagaattctcccaacatttttttttcttgagacagagtcttgctctgttgcccaggctagagtgcagtggtgcaatctcagttcactgcaacctctgcctcccgggttcaagcgattcttctgcctcagcctccctagtggctgggattacaggcgcctgctaccatgcctggctaatttttgtatttttagtagagatggggtttcaccatattggccaggctggtcttgaactcctgacttcaggtgacccacccgcctcggcctctcaaaatgctgggattacaggtgtgagccaccgtgcctggccaattccaacattcttaaattctctcatccctccagggctccccgtgctatgttctctttaccccttccccctcttctcttgctcaggcctgcaccactgcagccaccgttcatttattcattcattaaacactgagcactcactctgtgctgggtcccgggaagggtgagggggtcagacacaggccctgcccctgccctcagtgactggccagtccagcccaggcggggagagatgtgtacataggttttaaagcagacccagagctcatgggggcctgtgttctgggtgttcaggtgctgctggtcctccattacccactgctccccaaggctggtgggacggggtcccggtggcaggggcaggtatctccttcccgttcctcatccacctgcccagtgctcatcgttacagcaaaccccagggggccttggccaggtcaagggttctgtgaggagaggacccaggagtgtgggggcatttggggggtgaagtggcccccgaagaatggaacccacacccatagctctccccacagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgagggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttggaaaaaaaaaaaaaaaa

SEQ ID NO: 62 - protein, 259 aa, Homo Sapien [sequence omitted]

SEQ ID NO: 63 - DNA, 2412 bp, Homo Sapien
atgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgaggtggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccagggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcattgtctggcgtgtctgcgtggactggtgacgtgaatcaaaatcatccactgaaa

SEQ ID NO: 64 - protein, 453 aa, Homo Sapien
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 65 - DNA, 1572 bp, Homo Sapien
cgggccagcctggggcggccggccaggaaccacccgttaaggtgtcttctctttagggatggtgaggttggaaaaagactcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacaaacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattaaaaa

SEQ ID NO: 66 - protein, 234 aa, Homo Sapien
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLDFKVLPQEAEEENRLLIVQDASERAALIPGGLSDGQFYSPPESEAGSEEAEEKQDSEKPLLEL

SEQ ID NO: 67 - DNA, 2196 bp, Homo Sapien
aataaagcttccttaatgttgtatatgtctttgaagtacatccgtgcatttttttttagcatccaaccattcctcccttgtagttctcgccccctcaaatcaccctctcccgtagcccacccgactaacatctcagtctctgaaaatgcacagagatgcctggctacctcgccctgccttcagcctcacggggctcagtctctttttctctttggtgccaccaggacggagcatggaggtcacagtacctgccaccctcaacgtcctcaatggctctgacgcccgcctgccctgcaccttcaactcctgctacacagtgaaccacaaacagttctccctgaactggacttaccaggagtgcaacaactgctctgaggagatgttcctccagttccgcatgaagatcattaacctgaagctggagcggtttcaagaccgcgtggagttctcagggaaccccagcaagtacgatgtgtcggtgatgctgagaaacgtgcagccggaggatgaggggatttacaactgctacatcatgaacccccctgaccgccaccgtggccatggcaagatccatctgcaggtcctcatggaagagccccctgagcgggactccacggtggccgtgattgtgggtgcctccgtcgggggcttcctggctgtggtcatcttggtgctgatggtggtcaagtgtgtgaggagaaaaaaagagcagaagctgagcacagatgacctgaagaccgaggaggagggcaagacggacggtgaaggcaacccggatgatggcgccaagtagtgggtggccggccctgcagcctcccgtgtcccgtctcctcccctctccgccctgtacagtgaccctgcctgctcgctcttggtgtgcttcccgtgacctaggaccccagggcccacctggggcctcctgaacccccgacttcgtatctcccaccctgcaccaagagtgacccactctcttccatccgagaaacctgccatgctctgggacgtgtgggccctggggagaggagagaaagggctcccacctgccagtccctggggggaggcaggaggcacatgtgagggtccccagagagaagggagtgggtgggcaggggtagaggaggggccgctgtcacctgcccagtgcttgcctggcagtggcttcagagaggacctggtggggagggagggctttcctgtgctgacagcgctccctcaggagggccttggcctggcacggctgtgctcctcccctgctcccagcccagagcagccatcaggctggaggtgacgatgagttcctgaaacttggaggggcatgttaaagggatgactgtgcattccagggcactgacggaaagccagggctgcaggcaaagctggacatgtgccctggcccaggaggccatgttgggccctcgtttccattgctagtggcctccttggggctcctgttggctcctaatcccttaggactgtggatgaggccagactggaagagcagctccaggtagggggccatgtttcccagcggggacccaccaacagaggccagtttcaaagtcagctgaggggctgaggggtggggctccatggtgaatgcaggttgctgcaggctctgccttctccatggggtaaccaccctcgcctgggcaggggcagccaaggctgggaaatgaggaggccatgcacagggtggggcagctttctttggggcttcagtgagaactctcccagttgcccttggtggggtttccacctggcttttggctacagagagggaagggaaagcctgaggccggcataaggggaggccttggaacctgagctgccaatgccagccctgtcccatctgcggccacgctactcgctcctctcccaacaactcccttcgtggggacaaaagtgacaattgtaggccaggcacagtggctcacgcctgtaatcccagcactttgggaggccaaggcgggtggattacctccatctgtttagtagaaatgggcaaaaccccatctctactaaaaatacaagaattagctgggcgtggtggcgtgtgcctgtaatcccagctatttgggaggctgaggcaggagaatcgcttgagcccgggaagcagaggttgcagtgaactgagatagtgatagtgccactgcaattcagcctgggtgacatagagagactccatctcaaaaaaaa

SEQ ID NO: 68 - protein, 215 aa, Homo Sapien
MHRDAWLPRPAFSLTGLSLFFSLVPPGRSMEVTVPATLNVLNGSDARLPCTFNSCYTVNHKQFSLNWTYQECNNCSEEMFLQFRMKIINLKLERFQDRVEFSGNPSKYDVSVMLRNVQPEDEGIYNCYIMNPPDRHRGHGKIHLQVLMEEPPERDSTVAVIVGASVGGFLAVVILVLMVVKCVRRKKEQKLSTDDLKTEEEGKTDGEGNPDDGAK

SEQ ID NO: 69 - DNA, 3038 bp, Homo Sapien
ggcgcctggttctgcgcgtactggctgtacggagcaggagcaagaggtcgccgccagcctccgccgccgagcctcgttcgtgtccccgcccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgattttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaaaaaaaaaaaa

SEQ ID NO: 70 - protein, 500 aa, Homo Sapien
MKCTAREWLRVTTVLFMARAIPAMVVPNATLLEKLLEKYMDEDGEWWIAKQRGKRAITDNDMQSILDLHNKLRSQVYPTASNMEYMTWDVELERSAESWAESCLWEHGPASLLPSIGQNLGAHWGRYRPPTFHVQSWYDEVKDFSYPYEHECNPYCPFRCSGPVCTHYTQVVWATSNRIGCAINLCHNMNIWGQIWPKAVYLVCNYSPKGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 71 - DNA, 1879 bp, Homo Sapien
cagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaa

SEQ ID NO: 72 - protein, 518 aa, Homo Sapien
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 73 - DNA, 2956 bp, Homo Sapien
gccgcggcgagagcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaa

SEQ ID NO: 74 - protein, 432 aa, Homo Sapien
MPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 75 - DNA, 4640 bp, Homo Sapien
cggacgcgtgggcggacgcgtgggcaaaagaactcggagtgccaaagctaaataagttagctgagaaaacgcacgcagtttgcagcgcctgcgccgggtgcgccaactacgcaaagaccaagcgggctccgcgcggaccggccgcggggctagggacccggctttggccttcaggctccctagcagcggggaaaaggaattgctgcccggagtttctgcggaggtggagggagatcaggaaacggcttcttcctcacttcgccgcctggtgagtgtcggggagattggcaaacgcctaggaaaggactggggaaaatagccctgggaaagtggagaaggtgatcaggaggccggtccactacggcagtttatctgtctgatcagagccagacgcgacgcgtccacttcgcagttctttccaggtgtggggaccgcaggacagacggccgatcccgccgccctccgtaccagcactcccaggagagtcagcctcgctccccaacgtcgagggcgctctggccacgaaaagttcctgtccactgtgattctcaattccttgcttggtttttttctccagagaacttttgggtggagatattaacttttttctttttttttttccttggtggaagctgctctagggaggggggaggaggaggagaaagtgaaatgtgctggagaagagcgagccctccttgttcttccggagtcccatccattaagccatcacttctggaagattaaagttgtcggacatggtgacagctgagaggagaggaggatttcttgccaggtggagagtcttcaccgtctgttgggtgcatgtgtgcgcccgcagcggcgcggggcgcgtggttctccgcgtggagtctcacctgggacctgagtgaatggctcccaggggctgtgcggggcatccgcctccgccttctccacaggcctgtgtctgtcctggaaagatgctagcaatgggggcgctggcaggattctggatcctctgcctcctcacttatggttacctgtcctggggccaggccttagaagaggaggaagaaggggccttactagctcaagctggagagaaactagagcccagcacaacttccacctcccagccccatctcattttcatcctagcggatgatcagggatttagagatgtgggttaccacggatctgagattaaaacacctactcttgacaagctcgctgccgaaggagttaaactggagaactactatgtccagcctatttgcacaccatccaggagtcagtttattactggaaagtatcagatacacaccggacttcaacattctatcataagacctacccaacccaactgtttacctctggacaatgccaccctacctcagaaactgaaggaggttggatattcaacgcatatggtcggaaaatggcacttgggttttaacagaaaagaatgcatgcccaccagaagaggatttgataccttttttggttcccttttgggaagtggggattactatacacactacaaatgtgacagtcctgggatgtgtggctatgacttgtatgaaaacgacaatgctgcctgggactatgacaatggcatatactccacacagatgtacactcagagagtacagcaaatcttagcttcccataaccccacaaagcctatatttttatatactgcctatcaagctgttcattcaccactgcaagctcctggcaggtatttcgaacactaccgatccattatcaacataaacaggagaagatatgctgccatgctttcctgcttagatgaagcaatcaacaacgtgacattggctctaaagacttatggtttctataacaacagcattatcatttactcttcagataatggtggccagcctacggcaggagggagtaactggcctctcagaggtagcaaaggaacatattgggaaggagggatccgggctgtaggctttgtgcatagcccacttctgaaaaacaagggaacagtgtgtaaggaacttgtgcacatcactgactggtaccccactctcatttcactggctgaaggacagattgatgaggacattcaactagatggctatgatatctgggagaccataagtgagggtcttcgctcaccccgagtagatattttgcataacattgacccctatacaccaaggcaaaaaatggctcctgggcagcaggctatgggatctggaacactgcaatccagtcagccatcagagtgcagcactggaaattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagtgccggtcaggtatccccccaaagaccccagaagtaaccctaggctcaatggaggggtctggggaccatggtataaagaggaaaccaagaaaaagaagccaagcaaaaatcaggctgagaaaaagcaaaagaaaagcaaaaaaaagaagaagaaacagcagaaagcagtctcaggtaaaccagcaaatttggctcgataatatcgctggcctaagcgtcaggcttgttttcatgctgtgccactccagagacttctgccacctggccgccacactgaaaactgtcctgctcagtgccaaggtgctactcttgcaagccacacttagagagagtggagatgtttatttctctcgctcctttagaaaacgtggtgagtcctgagttccactgctgtgcttcagtcaactgaccaaacactgctttgaattataggaggagaacaataacctaccatccgcaagcatgctaatttgatggaagttacagggtagcatgattaaaactacctttgataaattacagtcaaagattgtgtcacctcaaaggccttgaagaatatattttcttggtgaatttttgtatgtctgtcatatgacacttgggttttttaattaattctattttatatatataaatatatgtttcttttcctgtgaaaagctgtttttctcacatgtgaacagcttgcacctcattttaccatgcgtgagggaatggcaaataagaatgtttgagcacactgcccacaatgaatgtaactattttctaaacactttactagaagaacatttcagtataaaaaacctaatttatttttacagaaaaatattttgttgtttttataaaaagttatgcaaatgacttttatttttatttcctgcataccattagaagaattttatttcatttcttcaaattatcaagcactgtaatactataaattaatgtaatactgtgtgaattcagactataaaaaacatcattcagaaaactttataatcgtcattgttcaatcaagattttgaatgtaataagatgaatatatattacttggaaattcaatgtttgtgcagagttgagacaactttattgtttctatcataaactatttatgtatcttaattattaaaatgatttactttatggcactagaaaatttactgtggcttttctgatctaacttctagctaaaattgtatcattggtcctaaaaaataaaaatctttactaataggcaattgaaggaatggtttgctaacaaccacagtaatataatatgattttacagatagatgcttccccttggctatgacatggagaaagattttcccataataataactaatatttatattaggttggtgcaaaactagttgcggtttttcccattaaaagtaataaccttactcttatacaaagtggacactgtggggagatacagagaaatggaagatacggatcctgcctggagtaggtaaccttgcttggaaaccccacatgcaaacgtcatgaggagaattaaaggagtattatcagtaatgaagtttatcatgggtcatcaatgagcatagattggtgtggatcctgtagaccctggtgttttctttgaagtgccctctcctaatgcagaggccttgaagcttacagtatacacttgaaaagtcacagatagctagaattatgatctttgaagttataactgtgatctgaaaatgtgtgtggtggtatgacagcataccattaaatacatttacatcacagctcaaaggactgtgatataatccatttatatcacaactcaaaggactgtgatataatccatttatatcacagctcacagtttctgaaaatgtataaaagaatctataatctagtactgaaattactaaattgggtaagatgatttaaatgattttaattttaacattttatttctagaatatatggctccattttattttatagtgtaaagttgtatttcctaaagtttgtgttttgtcgacagtatcttttaaatgagtcttaaaaataaaggcatattgttcatgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 76 - protein, 515 aa, Homo Sapien
MAPRGCAGHPPPPSPQACVCPGKMLAMGALAGFWILCLLTYGYLSWGQALEEEEEGALLAQAGEKLEPSTTSTSQPHLIFILADDQGFRDVGYHGSEIKTPTLDKLAAEGVKLENYYVQPICTPSRSQFITGKYQIHTGLQHSIIRPTQPNCLPLDNATLPQKLKEVGYSTHMVGKWHLGFNRKECMPTRRGFDTFFGSLLGSGDYYTHYKCDSPGMCGYDLYENDNAAWDYDNGIYSTQMYTQRVQQILASHNPTKPIFLYTAYQAVHSPLQAPGRYFEHYRSIININRRRYAAMLSCLDEAINNVTLALKTYGFYNNSIIIYSSDNGGQPTAGGSNWPLRGSKGTYWEGGIRAVGFVHSPLLKNKGTVCKELVHITDWYPTLISLAEGQIDEDIQLDGYDIWETISEGLRSPRVDILHNIDPYTPRQKMAPGQQAMGSGTLQSSQPSECSTGNCLQEILATATGSPLSLSATWDRTGGTMNGSPCQLAKVYGFSTSQPTHMRGWTYLTGIQES

SEQ ID NO: 77 - DNA, 3313 bp, Homo Sapien
aaaaaagctcactaaagtttctattagagcgaatacggtagatttccatccccttttgaagaacagtactgtggagctatttaagagataaaaacgaaatatcctttctgggagttcaagattgtgcagtaattggttaggactctgagcgccgctgttcaccaatcggggagagaaaagcggagatcctgctcgccttgcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgaggtgagtttatatcaaatcttctttctttttttttttaattgctctgtctcccaagctggagtgcagcggtacgatcatagctcactgcggcctcaaactcctaggctcaagcaattatcccacctttgcctccggtgtaacagggactacaggtgcaagccacctactgtctgcctatctatctatctatctatctatctatctatctatctatctatctatctattactttcttgtacagacgggagtctcacgcctgtaatcccagtactttgggaggccgaggcgggtggatcacctgaggttgggagtttgagaccagcctgaccaacatggagaaaccccgtctatactaaaaaaatacaaaattagccgggcgtggtggtgcatgtctgtaatcccagctacttgggaggctgagtcaggagaattgctttaacctgggaggtggaggttgcaatgagctgagattgtgccattgcactccagcctgggcaacaagagtgaaactctatctca

SEQ ID NO: 78 - protein, 916 aa, Homo Sapien
MIPARLHRDYKGLVLLGILLGTLWETGCTQIRYSVPEELEKGSRVGDISRDLGLEPRELAERGVRIIPRGRTQLFALNPRSGSLVTAGRIDREELCMGAIKCQLNLDILMEDKVKIYGVEVEVRDINDNAPYFRESELEIKISENAATEMRFPLPHAWDPDIGKNSLQSYELSPNTHFSLIVQNGADGSKYPELVLKRALDREEKAAHHLVLTASDGGDPVRTGTARIRVMVLDANDNAPAFAQPEYRASVPENLALGTQLLVVNATDPDEGVNAEVRYSFRYVDDKAAQVFKLDCNSGTISTIGELDHEESGFYQMEVQAMDNAGYSARAKVLITVLDVNDNAPEVVLTSLASSVPENSPRGTLIALLNVNDQDSEENGQVICFIQGNLPFKLEKSYGNYYSLVTDIVLDREQVPSYNITVTATDRGTPPLSTETHISLNVADTNDNPPVFPQASYSAYIPENNPRGVSLVSVTAHDPDCEENAQITYSLAENTIQGASLSSYVSINSDTGVLYALSSFDYEQFRDLQVKVMARDNGHPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADSIPQVLADLGSLESPANSETSDLTLYLVVAVAAVSCVFLAFVILLLALRLRRWHKSRLLQASGGGLTGAPASHFVGVDGVQAFLQTYSHEVSLTTDSRKSHLIFPQPNYADMLVSQESFEKSEPLLLSGDSVFSKDSHGLIEVSLYQIFFLFFFNCSVSQAGVQRYDHSSLRPQTPRLKQLSHLCLRCNRDYRCKPPTVCLSIYLSIYLSIYLSIYLLLSCTDGSLTPVIPVLWEAEAGGSPEVGSLRPA

SEQ ID NO: 79 - DNA, 2049 bp, Homo Sapien
agccgctgccccgggccgggcgcccgcggcggcaccatgagtccccgctcgtgcctgcgttcgctgcgcctcctcgtcttcgccgtcttctcagccgccgcgagcaactggctgtacctggccaagctgtcgtcggtggggagcatctcagaggaggagacgtgcgagaaactcaagggcctgatccagaggcaggtgcagatgtgcaagcggaacctggaagtcatggactcggtgcgccgcggtgcccagctggccattgaggagtgccagtaccagttccggaaccggcgctggaactgctccacactcgactccttgcccgtcttcggcaaggtggtgacgcaagggactcgggaggcggccttcgtgtacgccatctcttcggcaggtgtggcctttgcagtgacgcgggcgtgcagcagtggggagctggagaagtgcggctgtgacaggacagtgcatggggtcagcccacagggcttccagtggtcaggatgctctgacaacatcgcctacggtgtggccttctcacagtcgtttgtggatgtgcgggagagaagcaagggggcctcgtccagcagagccctcatgaacctccacaacaatgaggccggcaggaaggccatcctgacacacatgcgggtggaatgcaagtgccacggggtgtcaggctcctgtgaggtaaagacgtgctggcgagccgtgccgcccttccgccaggtgggtcacgcactgaaggagaagtttgatggtgccactgaggtggagccacgccgcgtgggctcctccagggcactggtaccacgcaacgcacagttcaagccgcacacagatgaggacctggtgtacttggagcctagccccgacttctgtgagcaggacatgcgcagcggcgtgctgggcacgaggggccgcacatgcaacaagacgtccaaggccatcgacggctgtgagctgctgtgctgtggccgcggcttccacacggcgcaggtggagctggctgaacgctgcagctgcaaattccactggtgctgcttcgtcaagtgccggcagtgccagcggctcgtggagttgcacacgtgccgatgaccgcctgcctagccctgcgccggcaaccacctagtggcccagggaaggccgataatttaaacagtctcccaccacctaccccaagagatactggttgtattttttgttctggtttggtttttgggtcctcatgttatttattgccgaaaccaggcaggcaaccccaagggcaccaaccagggcctccccaaagcctgggcctttgtggctgccactgaccaaagggaccttgctcgtgccgctggctgcccgcatgtggctgccactgaccactcagttgttatctgtgtccgtttttctacttgcagacctaaggtggagtaacaaggagtattaccaccacatggctactgaccgtgtcatcggggaagagggggccttatggcagggaaaataggtaccgacttgatggaagtcacaccctctggaaaaaagaactcttaactctccagcacacatacacatggactcctggcagcttgagcctagaagccatgtctctcaaatgccctgagaaagggaacaagcagataccaggtcaagggcaccaggttcatttcagcccttacatggacagctagaggttcgatatctgtgggtccttccaggcaagaagagggagatgagagcaagagacgactgaagtcccaccctagaacccagcctgccccagcctgcccctgggaagaggaaacttaaccactccccagacccacctaggcaggcatataggctgccatcctggaccagggatcccggctgtgcctttgcagtcatgcccgagtcacctttcacagcgctgttcctccatgaaactgaaaaacacacacacacacacacacacacacacacacacacacacacacacggacacacacacacacctgcgagagagagggaggaaagggctgtgcctttgcagtcatgcccgagtcacctttcacagcactgttcctc

SEQ ID NO: 80 - protein, 351 aa, Homo Sapien
MSPRSCLRSLRLLVFAVFSAAASNWLYLAKLSSVGSISEEETCEKLKGLIQRQVQMCKRNLEVMDSVRRGAQLAIEECQYQFRNRRWNCSTLDSLPVFGKVVTQGTREAAFVYAISSAGVAFAVTRACSSGELEKCGCDRTVHGVSPQGFQWSGCSDNIAYGVAFSQSFVDVRERSKGASSSRALMNLHNNEAGRKAILTHMRVECKCHGVSGSCEVKTCWRAVPPFRQVGHALKEKFDGATEVEPRRVGSSRALVPRNAQFKPHTDEDLVYLEPSPDFCEQDMRSGVLGTRGRTCNKTSKAIDGCELLCCGRGFHTAQVELAERCSCKFHWCCFVKCRQCQRLVELHTCR

SEQ ID NO: 81 - DNA, 3150 bp, Homo Sapien
ccgagccgggcgcgcagcgacggagctggggccggcctgggaccatgggcgtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagtgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccagacaaaacagatggtgaccagacttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattaggtagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaataa

SEQ ID NO: 82 - protein, 480 aa, Homo Sapien
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 83 - DNA, 3127 bp, Homo Sapien
tctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtccaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtaaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgttttgaaagtcactttgaaagttagttttgggcccagcacggtagctcacccttggtaatcccagcactttgggagcttaagtgggtagattacttgagcccaggaattcagaccagcttggcacatggtgaacctgttctataaaaataatctggctttgagcatatgcctgtggtccagcactgagaggctagtgaagattgctgagcccagagccaaaggttgcagtgagcaagtcacgtcactgcactctagctggcacagagtaagccaaaaaaatatatatatattgaaatcaaggaggcaaaattttgacagggaaggaagtaactgcaaaaccactaggctttagtaggtacttatataaaatctagtccagttctctcatttaaaaaaatgaagacactgaaatacagacttaaatagctcagatagctaattaggaaatttcaagttggccaataatagcattctctctgacatttaaaaataatttctattcaaaatacatgcatattgatttacacctcatactgtgataattaatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaaaaaa

SEQ ID NO: 84 - protein, 453 aa, Homo Sapien [sequence omitted]

SEQ ID NO: 85 - DNA, 971 bp, Homo Sapien
aacaaagttcagtgactgagagggctgagcggaggctgctgaaggggagaaaggagtgaggagctgctgggcagagagggactgtccggctcccagatgctgggcctcctggggagcacagccctcgtgggatggatcacaggtgctgctgtggcggtcctgctgctgctgctgctgctggccacctgccttttccacggacggcaggactgtgacgtggagaggaaccgtacagctgcagggggaaaccgagtccgccgggcccagccttggcccttccggcggcggggccacctgggaatctttcaccatcaccgtcatcctggccacgtatctcatgtgccgaatgtgggcctccaccaccaccaccacccccgccacacccctcaccacctccaccaccaccaccacccccaccgccaccatccccgccacgctcgctgaggctgctgtcgccggtgcctgtggacagcagctgcccctgccctcccatctgttcccaggacaagtggaccccatgtttccatgtggaaggatgcatctctggggtgaacgaggggaacaatagactggggcttgctccagctgcatttgcatggcatgccccagtgtactatggcagcagagaatggaggaacactgggtctgcagtgctgaagggtttggggagtggagagcaagggtgctctttcggggctggacagcccgtcttgtgacagtgactcccagtgagccccagaaatgacaagcgtgtcttggcagagccagcacacaagtggatgtgaagtgcccgtcttgacctcctcatcaggctgctgcaggcctctggcgggcagggcactgggagaggccctgagaatgtccttttggtttggagaaggcagtgtgaggctgcacagtcaattcatcggtgccttagtccaagaaaataaaaaccactaagaagctttaaaaaaaaaaaaaaaaaaaaa

SEQ ID NO: 86 - protein, 115 aa, Homo Sapien
MLGLLGSTALVGWITGAAVAVLLLLLLLATCLFHGRQDCDVERNRTAAGGNRVRRAQPWPFRRRGHLGIFHHHRHPGHVSHVPNVGLHHHHHPRHTPHHLHHHHHPHRHHPRHAR

SEQ ID NO: 87 - DNA, 3305 bp, Homo Sapien
cccacgcgtccgtcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaatgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccctctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcctccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcaatgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaat

SEQ ID NO: 88 - protein, 735 aa, Homo Sapien [sequence omitted]

SEQ ID NO: 89 - DNA, 1316 bp, Homo Sapien
ctgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccactg

SEQ ID NO: 90 - protein, 157 aa, Homo Sapien
MSGFLEGLRCSECIDWGEKRNTIASIAAGVLFFTGWWIIIDAAVIYPTMKDFNHSYHACGVIATIAFLMINAVSNGQVRGDSYSEGCLGQTGARIWLFVGFMLAFGSLIASMWILFGGYVAKEKDIVYPGIAVFFQNAFIFFGGLVFKFGRTEDLWQ

SEQ ID NO: 91 - DNA, 3004 bp, Homo Sapien
cgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcgtggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaaaaaaaaaaaaaaa

SEQ ID NO: 92 - protein, 610 aa, Homo Sapien
MWLPLVLLLAVLLLAVLCKVYLGLFSGSSPNPFSEDVKRPPAPLVTDKEARKKVLKQAFSANQVPEKLDVVVIGSGFGGLAAAAILAKAGKRVLVLEQHTKAGGCCHTFGKNGLEFDTGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGRSTMIMLIPTAYEWFEEWQAELKGKRGSDYETFKNSFVEASMSVVLKLFPQLEGKVESVTAGSPLTNQFYLAAPRGACYGADHDLGRLHPCVMASLRAQSPIPNLYLTGQDIFTCGLVGALQGALLCSSAILKRNLYSDLKNLDSRIRAQKKKN

SEQ ID NO: 93 - DNA, 2461 bp, Homo Sapien
gggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaaaaaaaaaaaaaaaagggcggccgcgactctagagtcgacctgcagtagggataacagggtaataagcttggccgccatgg

SEQ ID NO: 94 - protein, 348 aa, Homo Sapien
MAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 95 - DNA, 2579 bp, Homo Sapien
cctgtgttaagctgaggtttcccctagatctcgtatatccccaacacatacctccacgcacacacatccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggggaacacttaagaatctgtcctcaggaatatacatgctgcaccacagaaatggaagacaagttaagccaacaaagcaaactcgaatttgaaaaccttgtggaagagacaagccattttgtgcgcaccacttttgtgtccaggcataagaaatttgacgaatttttccgagagctcctggagaatgcagaaaagtcactaaatgatatgtttgtacggacctatggcatgctgtacatgcagaattcagaagtcttccaggacctcttcacagagctgaaaaggtactacactgggggtaatgtgaatctggaggaaatgctcaatgacttttgggctcggctcctggaacggatgtttcagctgataaaccctcagtatcacttcagtgaagactacctggaatgtgtgagcaaatacactgaccagctcaagccatttggagacgtgccccggaaactgaagattcaggttacccgcgccttcattgctgccaggacctttgtccaggggctgactgtgggcagagaagttgcaaaccgagtttccaaggtcagcccaaccccagggtgtatccgtgccctcatgaagatgctgtactgcccatactgtcgggggcttcccactgtgaggccctgcaacaactactgtctcaacgtcatgaagggctgcttggcaaatcaggctgacctcgacacagagtggaatctgtttatagatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataatcttgggtttttggtcagatgaaactgcattttagctatctgaatggccaactcacttcttttcttacactcttggacaatggaccatgccacaaaaacttaccgttttctatgagaagagagcagtaatgcaatctgcctccctttttgttttcccaaagagtaccgggtgccagactgaactgcttcctctttccttcagctatctgtggggaccttgtttattctagagagaattcttactcaaatttttcgtaccaggagattttcttaccttcatttgcttttatgctgcagaagtaaaggaatctcacgttgtgagggttttttttttctcatttaaaat

SEQ ID NO: 96 - protein, 555 aa, Homo Sapien
MPSWIGAVILPLLGLLLSLPAGADVKARSCGEVRQAYGAKGFSLADIPYQEIAGEHLRICPQEYTCCTTEMEDKLSQQSKLEFENLVEETSHFVRTTFVSRHKKFDEFFRELLENAEKSLNDMFVRTYGMLYMQNSEVFQDLFTELKRYYTGGNVNLEEMLNDFWARLLERMFQLINPQYHFSEDYLECVSKYTDQLKPFGDVPRKLKIQVTRAFIAARTFVQGLTVGREVANRVSKVSPTPGCIRALMKMLYCPYCRGLPTVRPCNNYCLNVMKGCLANQADLDTEWNLFIDAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 97 - protein, 1894 aa, Homo Sapien
GGCGGCGTCCGTGAGGGGCTCCTTTGGGCAGGGGTAGTGTTTGGTGTCCCTGTCTTGCGTGATATTGACAAACTGAAGCTTTCCTGCACCACTGGACTTAAGGAAGAGTGTACTCGTAGGCGGACAGCTTTAGTGGCCGGCCGGCCGCTCTCATCCCCCGTAAGGAGCAGAGTCCTTTGTACTGACCAAGATGAGCAACATCTACATCCAGGAGCCTCCCACGAATGGGAAGGTTTTATTGAAAACTACAGCTGGAGATATTGACATAGAGTTGTGGTCCAAAGAAGCTCCTAAAGCTTGCAGAAATTTTATCCAACTTTGTTTGGAAGCTTATTATGACAATACCATTTTTCATAGAGTTGTGCCTGGTTTCATAGTCCAAGGCGGAGATCCTACTGGCACAGGGAGTGGTGGAGAGTCTATCTATGGAGCGCCATTCAAAGATGAATTTCATTCACGGTTGCGTTTTAATCGGAGAGGACTGGTTGCCATGGCAAATGCTGGTTCTCATGATAATGGCAGCCAGTTTTTCTTCACACTGGGTCGAGCAGATGAACTTAACAATAAGCATACCATCTTTGGAAAGGTTACAGGGGATACAGTATATAACATGTTGCGACTGTCAGAAGTAGACATTGATGATGACGAAAGACCACATAATCCACACAAAATAAAAAGCTGTGAGGTTTTGTTTAATCCTTTTGATGACATCATTCCAAGGGAAATTAAAAGGCTGAAAAAAGAGAAACCAGAGGAGGAAGTAAAGAAATTGAAACCCAAAGGCACAAAAAATTTTAGTTTACTTTCATTTGGAGAGGAAGCTGAGGAAGAAGAGGAGGAAGTAAATCGAGTTAGTCAGAGCATGAAGGGCAAAAGCAAAAGTAGTCATGACTTGCTTAAGGATGATCCACATCTCAGTTCTGTTCCAGTTGTAGAAAGTGAAAAAGGTGATGCACCAGATTTAGTTGATGATGGAGAAGATGAAAGTGCAGAGCATGATGAATATATTGATGGTGATGAAAAGAACCTGATGAGAGAAAGAATTGCCAAAAAATTAAAAAAGGACACAAGTGCGAATGTTAAATCAGCTGGAGAAGGAGAAGTGGAGAAGAAATCAGTCAGCCGCAGTGAAGAGCTCAGAAAAGAAGCAAGACAATTAAAACGGGAACTCTTAGCAGCAAAACAAAAAAAAGTAGAAAATGCAGCAAAACAAGCAGAAAAAAGAAGTGAAGAGGAAGAAGCCCCTCCAGATGGTGCTGTTGCCGAATACAGAAGAGAAAAGCAAAAGTATGAAGCTTTGAGGAAGCAACAGTCAAAGAAGGGAACTTCCCGGGAAGATCAGACCCTTGCACTGCTGAACCAGTTTAAATCTAAACTCACTCAAGCAATTGCTGAAACACCTGAAAATGACATTCCTGAAACAGAAGTAGAAGATGATGAAGGATGGATGTCACATGTACTTCAGTTTGAGGATAAAAGCAGAAAAGTGAAAGATGCAAGCATGCAAGACTCAGATACATTTGAAATCTATGATCCTCGGAATCCAGTGAATAAAAGAAGGAGGGAAGAAAGCAAAAAGCTGATGAGAGAGAAAAAAGAAAGAAGATAAAATGAGAATAATGATAACCAGAACTTGCTGGAAATGTGCCTACAATGGCCTTGTAACAGCCATTGTTCCCAACAGCATCACTTAGGGGTGTGAAAAGAAGTATTTTTGAACCTGTTGTCTGGTTTTGAAAAACAATTATCTTGTTTTGCAAATTGTGGAATGATGTAAGCAAATGCTTTTGGTTACTGGTACATGTGTTTTTTCCTAGCTGACCTTTTATATTGCTAAATCTGAAATAAAATAACTTTCCTTCCACAAAAAAAAAAAAAAAAAAAAAAAAAAAAA

SEQ ID NO: 98 - protein, 472 aa, Homo Sapien
MSNIYIQEPPTNGKVLLKTTAGDIDIELWSKEAPKACRNFIQLCLEAYYDNTIFHRVVPGFIVQGGDPTGTGSGGESIYGAPFKDEFHSRLRFNRRGLVAMANAGSHDNGSQFFFTLGRADELNNKHTIFGKVTGDTVYNMLRLSEVDIDDDERPHNPHKIKSCEVLFNPFDDIIPREIKRLKKEKPEEEVKKLKPKGTKNFSLLSFGEEAEEEEEEVNRVSQSMKGKSKSSHDLLKDDPHLSSVPVVESEKGDAPDLVDDGEDESAEHDEYIDGDEKNLMRERIAKKLKKDTSANVKSAGEGEVEKKSVSRSEELRKEARQLKRELLAAKQKKVENAAKQAEKRSEEEEAPPDGAVAEYRREKQKYEALRKQQSKKGTSREDQTLALLNQFKSKLTQAIAETPENDIPETEVEDDEGWMSHVLQFEDKSRKVKDASMQDSDTFEIYDPRNPVNKRRREESKKLMREKKERR

SEQ ID NO: 99 - DNA, 1016 bp, Homo Sapien
cttttctgaggaaccacagcaatgaatggctttgcatccttgcttcgaagaaaccaatttatcctcctggtactatttcttttgcaaattcagagtctgggtctggatattgatagccgtcctaccgctgaagtctgtgccacacacacaatttcaccaggacccaaaggagatgatggtgaaaaaggagatccaggagaagagggaaagcatggcaaagtgggacgcatggggccgaaaggaattaaaggagaactgggtgatatgggagatcagggcaatattggcaagactgggcccattgggaagaagggtgacaaaggggaaaaaggtttgcttggaatacctggagaaaaaggcaaagcaggtactgtctgtgattgtggaagataccggaaatttgttggacaactggatattagtattgctcggctcaagacatctatgaagtttgtcaagaatgtgatagcagggattagggaaactgaagagaaattctactacatcgtgcaggaagagaagaactacagggaatccctaacccactgcaggattcggggtggaatgctagccatgcccaaggatgaagctgccaacacactcatcgctgactatgttgccaagagtggcttctttcgggtgttcattggcgtgaatgaccttgaaagggagggacagtacatgtccacagacaacactccactgcagaactatagcaactggaatgagggggaacccagcgacccctatggtcatgaggactgtgtggagatgctgagctctggcagatggaatgacacagagtgccatcttaccatgtactttgtctgtgagttcatcaagaagaaaaagtaacttccctcatcctacgtatttgctattttcctgtgaccgtcattacagttattgttatccatcctttttttcctgattgtactacatttgatctgagtcaacatagctagaaaatgctaaactgaggtatggagcctccatcatcaaaaaaaaaaaaaaaa

SEQ ID NO: 100 - protein, 277 aa, Homo Sapien [sequence omitted]

SEQ ID NO: 101 - DNA, 2747 bp, Homo Sapien
gcaacctcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcccccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaaatgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtccttatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactcttattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcactggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaataaaaaaaatgttaag

SEQ ID NO: 102 - protein, 211 aa, Homo Sapien
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 103 - DNA, 2558 bp, Homo Sapien
cccacgcgtccgcggacgcgtgggctggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttacataattttacacagataccacatttagcaggaacagaacaaaactttcagcttgcaaagcaaattcaatcccagtggaaagaatttggcctggattctgttgagctagctcattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagacggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacgagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattttttagagaatccgtattgaatttgtgtggtatgtcactcagaaagaatcgtaatgggtatattgataaattttaaaattggtatatttgaaataaagttgaatattatatataa

SEQ ID NO: 104 - protein, 750 aa, Homo Sapien [sequence omitted]

SEQ ID NO: 105 - DNA, 2857 bp, Homo Sapien
tgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagttatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattagggctttttaccatcaaaatttttaaaagtgctaatgtgtattcgaacccaatggtagtcttaaagagttttgtgccctggctctatggcggggaaagccctagtctatggagttttctgatttccctggagtaaatactccatggttattttaagctacctacatgctgtcattgaacagagatgtggggagaaatgtaaacaatcagctcacaggcatcaatacaaccagatttgaagtaaaataatgtaggaagatattaaaagtagatgagaggacacaagatgtagtcgatccttatgcgattatatcattatttacttaggaaagagtaaaaataccaaacgagaaaatttaaaggagcaaaaatttgcaagtcaaatagaaatgtacaaatcgagataacatttacatttctatcatattgacatgaaaattgaaaatgtatagtcagagaaattttcatgaattattccatgaagtattgtttcctttatttaaa

SEQ ID NO: 106 - protein, 772 aa, Homo Sapien
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 107 - DNA, 2478 bp, Homo Sapien
atctggttgaactacttaagcttaatttgttaaactccggtaagtacctagcccacatgatttgactcagagattctcttttgtccacagacagtcatctcaggggcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatcttttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaaaaaaaaaaaaaaaaaaaaaaaaaaaaaaaaa

SEQ ID NO: 108 - protein, 201 aa, Homo Sapien
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 109 - DNA, 2819 bp, Homo Sapien
ctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagatccctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgctttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtacgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggcaccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaaccctcgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagatttaaagaataaaaactcctgcataaacgatttcaggaatttgtattgcaatttcttaagatgaaaggaacagccaccaagcagtttcacactcactttactgatttctgtgtggactgagtacattcagctgacgaatttagttcccaggaagatggattgatgttcactagcttggacaacttctgcaaaatatgagactatttccacttgggaaaaattacaacagcaaaaaaaaaaaaaaaaaaaaaa

SEQ ID NO: 110 - protein, 438 aa, Homo Sapien [sequence omitted]

SEQ ID NO: 111 - DNA, 2285 bp, Homo Sapien
gcgtgccgtcagctcgccgggcaccgcggcctcgccctcgccctccgcccctgcgcctgcaccgcgtagaccgacccccccctccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaaaa

SEQ ID NO: 112 - protein, 243 aa, Homo Sapien
MAKVEQVLSLEPQHELKFRGPFTDVVTTNLKLGNPTDRNVCFKVKTTAPRRYCVRPNSGIIDAGASINVSVMLQPFDYDPNEKSKHKFMVQSMFAPTDTSDMEAVWKEAKPEDLMDSKLRCVFELPAENDKPHDVEINKIISTTASKTETPIVSKSLSSSLDDTEVKKVMEECKRLQGEVQRLREENKQFKEEDGLRMRKTVQSNSPISALAPTGKEEGLSTRLLALVVLFFIVGVIIGKIAL

SEQ ID NO: 113 - DNA, 1493 bp, Homo Sapien
cccacgcgtccgggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaaaaaaaaaaaaaaaaaaaaaaaag

SEQ ID NO: 114 - protein, 228 aa, Homo Sapien
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQDPRSWFCWLDQTS

SEQ ID NO: 115 - DNA, 2300 bp, Homo Sapien
ctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttccccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggaaaaaaa

SEQ ID NO: 116 - protein, 489 aa, Homo Sapien [sequence omitted]

SEQ ID NO: 117 - DNA, 2764 bp, Homo Sapien
gagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaagactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgacatataatttcatgaacgatgggttctttctaaaagtaacagtgctcagcttcacgcccagaccccaggaccacaacaccgacctcacctgccatgtggacttctccagaaagggtgtgagcgcacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcctccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctactaaaaatacaaaaattagctgggcatggtggcaggcgcctgtaatcctacctacttgggaagctgaggcaggagaatcacttgaacctgggagacggaggttgcagtgagccaagatcacaccattgcacgccagcctgggcaacaaagcgagactccatctcaaaaaaaaaatcctccaaatgggttgggtgtctgtaatcccagcactttgggaggctaaggtgggtggattgcttgagcccaggagttcgagaccagcctgggcaacatggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcaccttaaaaaaa

SEQ ID NO: 118 - protein, 544 aa, Homo Sapien [sequence omitted]

SEQ ID NO: 119 - DNA, 3951 bp, Homo Sapien
ctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccacgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaaaaaaaaaaaaaaaaaa

SEQ ID NO: 120 - protein, 1141 aa, Homo Sapien [sequence omitted]

SEQ ID NO: 121 - DNA, 1532 bp, Homo Sapien
ggcacgaggcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccctcaaaaaaaaaaaaaaa

SEQ ID NO: 122 - protein, 226 aa, Homo Sapien
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQEQSAI

SEQ ID NO: 123 - DNA, 1410 bp, Homo Sapien
cccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcaaaaaaaaaaaaaaaaaaaaaaaaaaaaaaaa

SEQ ID NO: 124 - protein, 217 aa, Homo Sapien
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQMESACVTIHEALKTVIDSQTHYRLREAQDRARAEDLNSRVSYWSVGETIALFVVSFSQVLLLKSFFTEKRPISRAVHS

SEQ ID NO: 125 - DNA, 756 bp, Homo Sapien
ggcacgaggcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatgaaaaaaaaaaaaaaaaaaa

SEQ ID NO: 126 - protein, 189 aa, Homo Sapien
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 127 - DNA, 1027 bp, Homo Sapien
  unsure 1017, 1020: unknown base
gcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgngcncagggcc

SEQ ID NO: 128 - protein, 138 aa, Homo Sapien
MISLTDTQKIGMGLTGFGVFFLFFGMILFFDKALLAIGNVLFVAGLAFVIGLERTFRFFFQKHKMKATGFFLGGVFVVLIGWPLIGMIFEIYGFFLLFRGFFPVVVGFIRRVPVLGSLLNLPGIRSFVDKVGESNNMV

SEQ ID NO: 129 - DNA, 1508 bp, Homo Sapien
aattcagattttaagcccattctgcagtggaatttcatgaactagcaagaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaacccaaaaaaaaaaaaaaaaaaaaaaaaaaaaaaaaaaaaaaaa

SEQ ID NO: 130 - protein, 319 aa, Homo Sapien
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 131 - DNA, 1818 bp, Homo Sapien
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaa

SEQ ID NO: 132 - protein, 300 aa, Homo Sapien
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKFLPERASAILNRMQNIQFEAVVGHKIKMK

SEQ ID NO: 133 - DNA, 1849 bp, Homo Sapien
ctgaggcggcggtagcatggagggggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcaaatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagctaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaaaaaaaaaaaaaaaaaaaaa

SEQ ID NO: 134 - protein, 409 aa, Homo Sapien [sequence omitted]

SEQ ID NO: 135 - DNA, 2651 bp, Homo Sapien
ggcacagccgcgcggcggagggcagagtcagccgagccgagtccagccggacgagcggaccagcgcagggcagcccaagcagcgcgcagcgaacgcccgccgccgcccacaccctctgcggtccccgcggcgcctgccacccttccctccttccccgcgtccccgcctcgccggccagtcagcttgccgggttcgctgccccgcgaaaccccgaggtcaccagcccgcgcctctgcttccctgggccgcgcgccgcctccacgccctccttctcccctggcccggcgcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatgaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcatagatgctatgctgatggtggcagagaggctagagggtcctttcaacattgaatcggtcatggatcccatcgatgtgaagatttctgatgctattatgaacatgcaggataatagtgttcaagtgtctcagaaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagc

SEQ ID NO: 136 - protein, 556 aa, Homo Sapien
MARFGLPALLCTLAVLSAALLAAELKSKSCSEVRRLYVSKGFNKNDAPLHEINGDHLKICPQGSTCCSQEMEEKYSLQSKDDFKSVVSEQCNHLQAVFASRYKKFDEFFKELLENAEKSLNDMFVKTYGHLYMQNSELFKDLFVELKRYYVVGNVNLEEMLNDFWARLLERMFRLVNSQYHFTDEYLECVSKYTEQLKPFGDVPRKLKLQVTRAFVAARTFAQGLAVAGDVVSKVSVVNPTAQCTHALLKMIYCSHCRGLVTVKPCYNYCSNIMRGCLANQGDLDFEWNNFIDAMLMVAERLEGPFNIESVMDPIDVKISDAIMNMQDNSVQVSQKVFQGCGPPKPLPAGRISRSISESAFSARFRPHHPEERPTTAAGTSLDRLVTDVKEKLKQAKKFWSSLPSNVCNDERMAAGNGNEDDCWNGKGKSRYLFAVTGNGLANQGNNPEVQVDTSKPDILILRQIMALRVMTSKMKNAYNGNDVDFFDISDESSGEGSGSGCEYQQCPSEFDYNATDHAGKSANEKADSAGVRPGAQAYLLTVFCILFLVMQREWR

SEQ ID NO: 137 - DNA, 2720 bp, Homo Sapien
gcgggctgttgacggcgctgcgatggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagagctatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaccgcaa

SEQ ID NO: 138 - protein, 699 aa, Homo Sapien
MAACEGRRSGALGSSQSDFLTPPVGGAPWAVATTVVMYPPPPPPPHRDFISVTLSFGESYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVPSGGYSSINNVQDPQKPEPRDKMESFFLGETLKYLFLLFSDDPNLLSLDAYVFNTEAHPLPIWTPA

SEQ ID NO: 139 - DNA, 870 bp, Homo Sapien
ctcgccctcaaatgggaacgctggcctgggactaaagcatagaccaccaggctgagtatcctgacctgagtcatccccagggatcaggagcctccagcagggaaccttccattatattcttcaagcaacttacagctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccaggaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatcattttgtttgttgctctctctagtgtcttcttctctcgtcagtcttagcctgtgccctccccttacccaggcttaggcttaattacctgaaagattccaggaaactgtagcttcctagctagtgtcatttaaccttaaatgcaatcaggaaagtagcaaacagaagtcaataaatatttttaaatgtcaaaaaaaaaaaaaaaaaa

SEQ ID NO: 140 - protein, 119 aa, Homo Sapien
MKVLISSLLLLLPLMLMSMVSSSLNPGVARGHRDRGQASRRWLQEGGQECECKDWFLRAPRRKFMTVSGLPKKQCPCDHFKGNVKKTRHQRHHRKPNKHSRACQQFLKQCQLRSFALPL

SEQ ID NO: 141 - DNA, 551 bp, Homo Sapien
aatggctgtcttagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacaggatttatggaatttgatgataatgaaggaaaacattcatcaaagtgacatcctcaggacacacccatgtggctcctggacaatccaagagcagccaaatcctgcttttccagtttggctccacaagtcctccaggacagagccctcaaagcaactcccaacgagttctcaggattcaggctctggcttcaaccaaacagaactcattttgaacaccctgactgcatttttgcttttagaaagttagaataaatatggcgctttgggatcacatagttgatggagaggaaaaaaaaaaaaaaaaaaaaaaaaaaaaaaaaaaaaaaaaaaaaaa

SEQ ID NO: 142 - protein, 87 aa, Homo Sapien
MAVLVLRLTVVLGLLVLFLTCYADDKPDKPDDKPDDSGKDPKPDFPKFLSLLGTEIIENAVEFILRSMSRSTGFMEFDDNEGKHSSK

SEQ ID NO: 143 - DNA, 1371 bp, Homo Sapien
ggacgccagcgcctgcagaggctgagcagggaaaaagccagtgccccagcggaagcacagctcagagctggtctgccatggacatcctggtcccactcctgcagctgctggtgctgcttcttaccctgcccctgcacctcatggctctgctgggctgctggcagcccctgtgcaaaagctacttcccctacctgatggccgtgctgactcccaagagcaaccgcaagatggagagcaagaaacgggagctcttcagccagataaaggggcttacaggagcctccgggaaagtggccctactggagctgggctgcggaaccggagccaactttcagttctacccaccgggctgcagggtcacctgcctagacccaaatccccactttgagaagttcctgacaaagagcatggctgagaacaggcacctccaatatgagcggtttgtggtggctcctggagaggacatgagacagctggctgatggctccatggatgtggtggtctgcactctggtgctgtgctctgtgcagagcccaaggaaggtcctgcaggaggtccggagagtactgagaccgggaggtgtgctctttttctgggagcatgtggcagaaccatatggaagctgggccttcatgtggcagcaagttttcgagcccacctggaaacacattggggatggctgctgcctcaccagagagacctggaaggatcttgagaacgcccagttctccgaaatccaaatggaacgacagccccctcccttgaagtggctacctgttgggccccacatcatgggaaaggctgtcaaacaatctttcccaagctccaaggcactcatttgctccttccccagcctccaattagaacaagccacccaccagcctatctatcttccactgagagggacctagcagaatgagagaagacattcatgtaccacctactagtccctctctccccaacctctgccagggcaatctctaacttcaatcccgccttcgacagtgaaaaagctctacttctacgctgacccagggaggaaacactaggaccctgttgtatcctcaactgcaagtttctggactagtctcccaacgtttgcctcccaatgttgtccctttccttcgttcccatggtaaagctcctctcgctttcctcctgaggctacacccatgcgtctctaggaactggtcacaaaagtcatggtgcctgcatccctgccaagcccccctgaccctctctccccactaccaccttcttcctgagctgggggcaccagggagaatcagagatgctggggatgccagagcaagactcaaagaggcagaggttttgttctcaaatattttttaataaatagacgaaaccacg

SEQ ID NO: 144 - protein, 277 aa, Homo Sapien [sequence omitted]

SEQ ID NO: 145 - DNA, 1621 bp, Homo Sapien
gtgggatttatttgagtgcaagatcgttttctcagtggtggtggaagttgcctcatcgcaggcagatgttggggctttgtccgaacagctcccctctgccagcttctgtagataagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcatgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttc

SEQ ID NO: 146 - protein, 371 aa, Homo Sapien
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSDSLKSIRYKIVNFDPKLLEGKVKEDPDQGESMKPLTFARFYLPILVPSAKKAIYMDDDVIVQGDILALYNTALKPGHAAAFSEDCDSASTKVVIRGAGNQYNYIGYLDYKKERIRKLSMKASTCSFNPGVFVANLTEWKRQNITNQLEKWMKLNVEEGLYSRTLAGSITTPPLLIVFYQQHSTIDPMWNVRHLGSSAGKRYSPQFVKAAKLLHWNGHLKPWGRTASYTDVWEKWYIPDPTGKFNLIRRYTEISNIK

SEQ ID NO: 147 - DNA, 1660 bp, Homo Sapien
gtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctcaaaa

SEQ ID NO: 148 - protein, 445 aa, Homo Sapien
MSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 149 - DNA, 2773 bp, Homo Sapien
gttcgattagctcctctgagaagaagagaaaaggttcttggacctctccctgtttcttccttagaataatttgtatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgatttgaactctgtaaccctcagcaagtttcatttttgtcatgacaatgtaggaattgctgaattaaatgtttagaaggatgaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 150 - protein, 678 aa, Homo Sapien
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 151 - DNA, 1759 bp, Homo Sapien
caggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccttgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcataaaa

SEQ ID NO: 152 - protein, 541 aa, Homo Sapien [sequence omitted]

SEQ ID NO: 153 - DNA, 1486 bp, Homo Sapien
cggacgcgtgggcggacgcgtgggcggacgcgtgggttgggagggggcaggatgggagggaaagtgaagaaaacagaaaaggagagggacagaggccagaggacttctcatactggacagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggatgctggtgggcgccccctgggatgggccttcaggcgaccggaggggggacgtttatcgctgccctgtagggggggcccacaatgccccatgtgccaagggccacttaggtgactaccaactgggaaattcatctcatcctgctgtgaatatgcacctggggatgtctctgttagagacagatggtgatgggggattcatggtgagctaaggagagggtggtggcagtgtctctgaaggtccataaaagaaaaaagagaagtgtggtaagggaaaatggtctgtgtggaggggtcaaggagttaaaaaccctagaaagcaaaaggtaggtaatgtcagggagtagtcttcatgcctccttcaactgggagcatgttctgagggtgccctcccaagcctgggagtaactatttcccccatccccaggcctgtgcccctctctggtctcgtgcttgtggcagctctgtcttcagttctgggatatgtgcccgtgtggatgcttcattccagcctcagggaagcctggcacccactgcccaacgtgagccagaggaaggctgagtacttggttcccagaaggagatactgggtgggaaaaagatggggcaaagcggtatgatgcctggcaaagggcctgcatggctatcctcattgctacctaatgtgcttgcaaaagctccatgtttcctaacagattcagactcctggccaggtgtggtggcccacacctgtaattctagcactttgggaggccaaggtgggcagatcacttgaggtcaggagttcaagaccagcctggccaacatggtgaaactccatctctactaaaaaaaaaaaaatacaaaaattagctgggtgcgctagtgcatgcctgtaatctcatctactcgggaggctaagacaggagactctcacttcaacccaggaggtggaggttgcggtgagccaagattgtgcctctgcactctagcgtgggtgacagagtaagcgagactccatctcaaaaataataataataataattcagactccttatcaggagtccatgatctggcctggcacagtaactcatgcctgtaatcccaacattttgggaggccaacgcaggaggattgcttgaggtctggaggtttgagaccagcctgggcaacatagaaagaccccatctctaaataaatgttttaaaaat

SEQ ID NO: 154 - protein, 124 aa, Homo Sapien
MELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMVS

SEQ ID NO: 155 - DNA, 2530 bp, Homo Sapien
gcgagctccgggtgctgtggcccggccttggcggggcggcctccggctcaggctggctgagaggctcccagctgcagcgtccccgcccgcctcctcgggagctctgatctcagctgacagtgccctcggggaccaaacaagcctggcagggtctcactttgttgcccaggctggagttcagtgccatgatcatggtttactgcagccttgacctcctgggttcaagcgatcctgctgagtagctgggactacaggacaaaattagaagatcaaaatggaaaatatgctgctttggttgatatttttcacccctgggtggaccctcattgatggatctgaaatggaatgggattttatgtggcacttgagaaaggtaccccggattgtcagtgaaaggactttccatctcaccagccccgcatttgaggcagatgctaagatgatggtaaatacagtgtgtggcatcgaatgccagaaagaactcccaactcccagcctttctgaattggaggattatctttcctatgagactgtctttgagaatggcacccgaaccttaaccagggtgaaagttcaagatttggttcttgagccgactcaaaatatcaccacaaagggagtatctgttaggagaaagagacaggtgtatggcaccgacagcaggttcagcatcttggacaaaaggttcttaaccaatttccctttcagcacagctgtgaagctttccacgggctgtagtggcattctcatttcccctcagcatgttctaactgctgcccactgtgttcatgatggaaaggactatgtcaaagggagtaaaaagctaagggtagggttgttgaagatgaggaataaaagtggaggcaagaaacgtcgaggttctaagaggagcaggagagaagctagtggtggtgaccaaagagagggtaccagagagcatctgcaggagagagcgaagggtgggagaagaagaaaaaaatctggccggggtcagaggattgccgaagggaggccttcctttcagtggacccgggtcaagaatacccacattccgaagggctgggcacgaggaggcatgggggacgctaccttggactatgactatgctcttctggagctgaagcgtgctcacaaaaagaaatacatggaacttggaatcagcccaacgatcaagaaaatgcctggtggaatgatccacttctcaggatttgataacgatagggctgatcagttggtctatcggttttgcagtgtgtccgacgaatccaatgatctcctttaccaatactgcgatgctgagtcgggctccaccggttcgggggtctatctgcgtctgaaagatccagacaaaaagaattggaagcgcaaaatcattgcggtctactcagggcaccagtgggtggatgtccacggggttcagaaggactacaacgttgctgttcgcatcactcccctaaaatacgcccagatttgcctctggattcacgggaacgatgccaattgtgcttacggctaacagagacctgaaacagggcggtgtatcatctaaatcacagagaaaaccagctctgcttaccgtagtgagatcacttcataggttatgcctggacttgaactctgtcaatagcatttcaacatttttcaaaatcaggagattttcgtccatttaaaaaatgtataggtgcagatattgaaactaggtgggcacttcaatgccaagtatatactcttctttacatggtgatgagtttcatttgtagaaaaattttgttgccttcttaaaaattagacacactttaaaccttcaaacaggtattataaataacatgtgactccttaatggacttattctcagggtcctactctaagaagaatctaataggatgctggttgtgtattaaatgtgaaattgcatagataaaggtagatggtaaagcaattagtatcagaatagagacagaaagttacaacacagtttgtactactctgagatggatccattcagctcatgccctcaatgtttatattgtgttatctgttgggtctgggacatttagtttagtttttttgaagaattacaaatcagaagaaaaagcaagcattataaacaaaactaataactgttttactgctttaagaaataacaattacaatgtgtattatttaaaaatgggagaaatagtttgttctatgaaataaacctagtttagaaatagggaagctgagacattttaagatctcaagtttttatttaactaatactcaaaatatggacttttcatgtatgcatagggaagacacttcacaaattatgaatgatcatgtgttgaaagccacattattttatgctatacattctatgtatgaggtgctacatttttaggacaaagaattctgtaatctttttcaagaaagagtctttttctccttgacaaaatccagcttttgtatgaggactatagggtgaattctctgattagtaattttagatatgtcctttcctaaaaatgaataaaatttatgaatatga

SEQ ID NO: 156 - protein, 413 aa, Homo Sapien
MENMLLWLIFFTPGWTLIDGSEMEWDFMWHLRKVPRIVSERTFHLTSPAFEADAKMMVNTVCGIECQKELPTPSLSELEDYLSYETVFENGTRTLTRVKVQDLVLEPTQNITTKGVSVRRKRQVYGTDSRFSILDKRFLTNFPFSTAVKLSTGCSGILISPQHVLTAAHCVHDGKDYVKGSKKLRVGLLKMRNKSGGKKRRGSKRSRREASGGDQREGTREHLQERAKGGRRRKKSGRGQRIAEGRPSFQWTRVKNTHIPKGWARGGMGDATLDYDYALLELKRAHKKKYMELGISPTIKKMPGGMIHFSGFDNDRADQLVYRFCSVSDESNDLLYQYCDAESGSTGSGVYLRLKDPDKKNWKRKIIAVYSGHQWVDVHGVQKDYNVAVRITPLKYAQICLWIHGNDANCAYG

SEQ ID NO: 157 - DNA, 2883 bp, Homo Sapien
gggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccacccggacgccggcggggccgcgcgcagccgccgctgttgctgccgctctcgctgttagcgctgctcgcgctgctgggaggcggcggcggcggcggcgccgcggcgctgcccgccggctgcaagcacgatgggcggccccgaggggctggcagggcggcgggcgccgccgagggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaaggtatgttacattctgcaatcatttaagactatttacagttaaattagaatgctccaaatgttctgcttcgcaaaataaccttattaaaagatttttttttgcaggaagataggtattattgcttttgctactgttttaaagaaaactaaccaggaagaactgcattacgactttcaagggccctaggcatttttgcctttgattccctttcttcacataaaaatatcagaaattacattttataactgcagtggtataaatgcaaatatactattgttacatgtgaaaaaattttatttgacttaaaagtttatttatttgtttttttgctcctgattttaagacaataagatgttttcatgggcccctaaaagtatcatgagcctttggcactgcgcctgccaagcctagtggagaagtcaaccctgagaccaggtgtttaatcaagcaagctgtatatcaaaatttttggcagaaaacacaaatatgtcatatatctttttttaaaaaaagtatttcattgaagcaagcaaaatgaaagcatttttactgatttttaaaattggtgctttagatatatttgactacactgtattgaagcaaatagaggaggcacaactccagcaccctaatggaaccacatttttttcacttagctttctgtgggcatgtgtaattgtattctctgcggtttttaatctcacagtactttatttctgtcttgtccctcaataatatcacaaacaatattccagtcattttaatggctgcataataactgatccaacaggtgttaggtgttctggtttagtgtgagcactcaataaatattgaatgaatgaacgaaaaaaaaaaaaaaaa

SEQ ID NO: 158 - protein, 616 aa, Homo Sapien
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKVCYILQSFKTIYS

SEQ ID NO: 159 - DNA, 1917 bp, Homo Sapien
ggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggctcctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctctaaagccaaa

SEQ ID NO: 160 - protein, 392 aa, Homo Sapien
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNPKLVDAEYTKNQAWKSMKDTLGKPAAKDVHLVDHCKYKYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 161 - DNA, 2095 bp, Homo Sapien
ccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggataccttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaaaa

SEQ ID NO: 162 - protein, 331 aa, Homo Sapien
MASALWTVLPSRMSLRSLKWSLLLLSLLSFFVMWYLSLPHYNVIERVNWMYFYEYEPIYRQDFHFTLREHSNCSHQNPFLVILVTSHPSDVKARQAIRVTWGEKKSWWGYEVLTFFLLGQEAEKEDKMLALSLEDEHLLYGDIIRQDFLDTYNNLTLKTIMAFRWVTEFCPNAKYVMKTDTDVFINTGNLVKYLLNLNHSEKFFTGYPLIDNYSYRGFYQKTHISYQEYPFKVFPPYCSGLGYIMSRDLVPRIYEMMGHVKPIKFEDVYVGICLNLLKVNIHIPEDTNLFFLYRIHLDVCQLRRVIAAHGFSSKEIITFWQVMLRNTTCHY

SEQ ID NO: 163 - DNA, 1706 bp, Homo Sapien
catttctgaaactaatcgtgtcagaattgactttgaaaagcattgctttttacagaagtatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaaaaaaaaaaaaaaaaagt

SEQ ID NO: 164 - protein, 299 aa, Homo Sapien
MNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRHYNNRRSRSGTYSSRSRSRSRSHSESPRRHHNHGSPHLKAKHTRDDLKSSNRHGHKRKKSRSRSQSKSRDHSDAAKKHRHERGHHRDRRERSRSFERSHKSKHHGGSRSGHGRHRR

SEQ ID NO: 165 - DNA, 2571 bp, Homo Sapien
ggttcctacatcctctcatctgagaatcagagagcataatcttcttacgggcccgtgatttattaacgtggcttaatctgaaggttctcagtcaaattctttgtgatctactgattgtgggggcatggcaaggtttgcttaaaggagcttggctggtttgggcccttgtagctgacagaaggtggccagggagaatgcagcacactgctcggagaatgaaggcgcttctgttgctggtcttgccttggctcagtcctgctaactacattgacaatgtgggcaacctgcacttcctgtattcagaactctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgattgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaagttaaa

SEQ ID NO: 166 - protein, 632 aa, Homo Sapien
MKALLLLVLPWLSPANYIDNVGNLHFLYSELCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 167 - DNA, 735 bp, Homo Sapien
gggaaagccatttcgaaaacccatctatacaaactatatattttcatttctgctgctagctgccttgggcctcacaattttcattctgttttctgactttcaagttatataccgtggaatggagttgatcccaaccataacatcgtggagggttttaattttggtggtagccctcacccaattctggtgtggctttctttgcagaggattccaccttcaaaatcatgaactctggctgttgatcaaaagagaatttggattctactctaaaagtcaatataggacttggcaaaagaagctagcagaagactcaacctggcctcccataaacaggacagattattcaggtgatggcaaaaatggattctacatcaacggaggctatgaaagccatgaacagattccaaaaagaaaactcaaattgggaggccaacccacagaacagcatttctgggccaggctgtaatcagaattgtcgtcgtacatgctcaacagcattgcttttttccccaaaattaacacattgtggagaagtgatgatactctccccttacctttcctctctccattcaagcattcaaagtatattttcaatgaattaaaccttgcagcaagggaccttagataggcttattctgactgtatgctttaccaatgagagaaaaaaatgcatttcctgtatcatccttttcaataaactgtattcattttgaaaaaaaaaaaaaaaaaaaaaaa

SEQ ID NO: 168 - protein, 115 aa, Homo Sapien [sequence omitted]

SEQ ID NO: 169 - DNA, 2846 bp, Homo Sapien
cgctcgggcaccagccgcggcaaggatggagctgggttgctggacgcagttggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgcgatgtggccaggttctgcgagccccaaagggtcagattttgttggaaagctatcccctaaatgctcactgtgaatggaccattcatgctaaacctgggtttgtcatccaactaagatttgtcatgttgagtctggagtttgactacatgtgccagtatgactatgttgaggttcgtgatggagacaaccgcgatggccagatcatcaagcgtgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatctccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccgcgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 170 - protein, 720 aa, Homo Sapien
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 171 - DNA, 2128 bp, Homo Sapien
ctgtcgtctttgcttcagccgcagtcgccactggctgcctgaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttcttttttttttttttttttaagacggattctcactctgtggcccaggctggagtgcagtggtgcgatctcagctcactgcaacccccgcctcctgggttcaagcgattctcctcccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaag

SEQ ID NO: 172 - protein, 322 aa, Homo Sapien
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWPLYQFDEKYGGQPRRSRDVSCSRSHAYYVCAWDRRLAVAILTAINLLAYVADLVHSAHLVFVKV

SEQ ID NO: 173 - DNA, 3680 bp, Homo Sapien
gaacgtgccaccatgcccagctaatttttgtatttttagtagagacggggtttcaccatgttggccaggctggtcttgaactcgtgacctcatgatccgctcacctcggcctcccaaagtgctgggattacaggcatgagccactgacgcctggccagcctatgcatttttaagaaattattctgtattaggtgctgtgctaaacattgggcactacagtgaccaaaacagactgaattccccaagagccaaagaccagtgagggagaccaacaagaaacaggaaatgcaaaagagaccattattactcactatgactaagggtcacaaatggggtacgttgatggagagtgatttgttaagagactacagagggaggacagactaccaagaggggggccaggaaagctcctctgacgaggtggtatttcagcccaaactggaagaatgagaaagagctagccagccatcagaatagtccagaagagatggggagcactacactcactacactttggcctgagaaaatagcatgggattggaggaggctgggggaacaccacttctgccgacctgggcaggaggcattgagggcttgagaaagggcaatggcagtagcagtagaaaggacagggtaggagcagggactttgcaggtggaatcattaggtcttatcaacagatatgggcaagcaaagccaggggagaattgatggtaatgctgaggtttggagccaggctagatgggacagtggtgggtgatgcaaaggaaagaggtcaggaagcagggccagacgtggggagaaggtgtgggggtttggtttccatcttgccgagtctgccggaatgtggatgggaagaccaagaggaggagcaaggggcagaggggaagggaatcttaaagaagtcctggatgccacactcttcttccttcctcctcttccctctcctcagaggtctcactcgtggttcttcatttcctgccctgcctccatctcctctgggtgctgggaaagtggaggattagctgaagttttgcttctcggggcctgtctgaatctccattgctttctgggaggacataattcacctgtcctagcttcttatcatcttacatttccctgtagccactgggacatatgtggtgttccttcctagctcctgtctcctcctcatgcctttgctgggtatgggcatgttagggggaaggtcattgctgtcagaggggcactgactttctaatggtgttacccaaggtgaatgttggagacacagtcgcgatgctgcccaagtcccggcgagccctaactatccaggagatcgctgcgctggccaggtcctccctgcatggtatgcagcccctcccatgtttctggccactttgtcctttctcctcccgtttgcacatccctttggaactgtttcctgtgagtacatgctggggtctcccctttcttcccttgctcaggtgaatctcagccccttctcccacccaaaggttcacatggatcctaactactgccacccttccacctccctgcacctgtgctccctggcctggtcctttaccaggcttctccaccctcccctatctccaggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctaaaa

SEQ ID NO: 174 - protein, 335 aa, Homo Sapien
MFLATLSFLLPFAHPFGTVSCEYMLGSPLSSLAQVNLSPFSHPKVHMDPNYCHPSTSLHLCSLAWSFTRLLHPPLSPGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 175 - DNA, 2084 bp, Homo Sapien
ggttcctgggcgctctgttacacaagcaagatacagccagccccacctaattttgtttccctggcaccctcctgctcagtgcgacattgtcacacttaacccatctgttttctctaatgcacgacagattcctttcagacaggacaactgtgatatttcagttcctgattgtaaatacctcctaagcctgaagcttctgttactagccattgtgagcttcagtttcttcatctgcaaaatgggcataatacaatctattcttgccacatcaagggattgttattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcatcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaagaaaatagaaatacaggaatagtattcggggccattttaggtgctattctgggtgtctcattgcttactcttgtgggctacttgttgtgtggaaaaaggaaaacggattcattttcccatcggcgactttatgacgacagaaatgaaccagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaacaatgaagatgactctttactgctctgcctgaagccctagtaccataattcaagattgcattttcttaaatgaaaattgaaagggtgctttttaaagaaaatttgacttaaagctaaaaagaggacatagcccagagtttctgttattgggaaattgaggcaatagaaatgacagacctgtattctagtacgttataattttctagatcagcacacacatgatcagcccactgagttatgaagctgacaatgactgcattcaacggggccatggcaggaaagctgaccctacccaggaaagtaatagcttctttaaaagtcttcaaaggttttgggaattttaacttgtcttaatatatcttaggcttcaattatttgggtgccttaaaaactcaatgagaatcatggt

SEQ ID NO: 176 - protein, 334 aa, Homo Sapien
MLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNTGIVFGAILGAILGVSLLTLVGYLLCGKRKTDSFSHRRLYDDRNEPVLRLDNAPEPYDVSFGNSSYYNPTLNDSAMPESEENARDGIPMDDIPPLRTSV

SEQ ID NO: 177 - DNA, 1964 bp, Homo Sapien
accaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgtccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctggatcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcaggtgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagcaaaa

SEQ ID NO: 178 - protein, 344 aa, Homo Sapien
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKVNGFSNNYWGWGGEDDDLRLRVELQRMKISRPLPEVGKYTMVFHTRDKGNEVNAERMKLLHQVSRVWRTDGLSSCSYKLVSVEHNPLYINITVDFWFGA

SEQ ID NO: 179 - DNA, 2567 bp, Homo Sapien
cgtgggccggggtcgcgcagcgggctgtgggcgcgcccggaggagcgaccgccgcagttctcgagctccagctgcattccctccgcgtccgccccacgcttctcccgctccgggccccgcaatggcccaggcagtgtggtcgcgcctcggccgcatcctctggcttgcctgcctcctgccctgggccccggcaggggtggccgcaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcctaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcaggggcctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctcca

SEQ ID NO: 180 - protein, 423 aa, Homo Sapien
MAQAVWSRLGRILWLACLLPWAPAGVAAGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 181 - DNA, 1533 bp, Homo Sapien
cggacgcgtgggcggcggctgcggaactcccgtggaggggccggtgggccctcgggcctgacagatggcagtggccactgcggcggcagtactggccgctctgggcggggcgctgtggctggcggcccgccggttcgtggggcccagggtccagcggctgcgcagaggcggggaccccggcctcatgcacgggaagactgtgctgatcaccggggcgaacagcggcctgggccgcgccacggccgccgagctactgcgcctgggagcgcgggtgatcatgggctgccgggaccgcgcgcgcgccgaggaggcggcgggtcagctccgccgcgagctccgccaggccgcggagtgcggcccagagcctggcgtcagcggggtgggcgagctcatagtccgggagctggacctcgcctcgctgcgctcggtgcgcgccttctgccaggaaatgctccaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccggagcaaactggctaacattctttttaccagggaactagcccgccgcttagaaggcacaaatgtcaccgtcaatgtgttgcatcctggtattgtacggacaaatctggggaggcacatacacattccactgttggtcaaaccactcttcaatttggtgtcatgggcttttttcaaaactccagtagaaggtgcccagacttccatttatttggcctcttcacctgaggtagaaggagtgtcaggaagatactttggggattgtaaagaggaagaactgttgcccaaagctatggatgaatctgttgcaagaaaactctgggatatcagtgaagtgatggttggcctgctaaaataggaacaaggagtaaaagagctgtttataaaactgcatatcagttatatctgtgatcaggaatggtgtggattgagaacttgttacttgaagaaaaagaattttgatattggaatagcctgctaagaggtacatgtgggtattttggagttactgaaaaattatttttgggataagagaatttcagcaaagatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggtgtgtgcacacaagtcttacttggaataaatttactggtac

SEQ ID NO: 182 - protein, 336 aa, Homo Sapien
MAVATAAAVLAALGGALWLAARRFVGPRVQRLRRGGDPGLMHGKTVLITGANSGLGRATAAELLRLGARVIMGCRDRARAEEAAGQLRRELRQAAECGPEPGVSGVGELIVRELDLASLRSVRAFCQEMLQEEPRLDVLINNAGIFQCPYMKTEDGFEMQFGVNHLGHFLLTNLLLGLLKSSAPSRIVVVSSKLYKYGDINFDDLNSEQSYNKSFCYSRSKLANILFTRELARRLEGTNVTVNVLHPGIVRTNLGRHIHIPLLVKPLFNLVSWAFFKTPVEGAQTSIYLASSPEVEGVSGRYFGDCKEEELLPKAMDESVARKLWDISEVMVGLLK

SEQ ID NO: 183 - DNA, 1594 bp, Homo Sapien
aacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaaaactactaaccactgcaagctcttgtcaaattttagtttaattggcattgcttgttttttgaaactgaaattacatgagtttcattttttctttgcatttatagggtttagatttctgaaagcagcatgaatatatcacctaacatcctgacaataaattccatccgttgttttttttgtttgtttgttttttcttttcctttaagtaagctctttattcatcttatggtggagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaaaaaaaaaaaaaaaaaaa

SEQ ID NO: 184 - protein, 263 aa, Homo Sapien
MVKIAFNTPTAVQKEEARQDVEALLSRTVRTQILTGKELRVATQEKEGSSGRCMLTLLGLSFILAGLIVGGACIYKYFMPKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKNLVELFGKLASGRYLPQTYVVREDLVAVEEIRDVSNLGIFIYQLCNNRKSFRLRRRDLLLGFNKRAIDKCWKIRHFPNEFIVETKICQE

SEQ ID NO: 185 - DNA, 485 bp, Homo Sapien
gctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 186 - protein, 84 aa, Homo Sapien
MALSSQIWAACLLLLLLLASLTSGSVFPQQTGQLAELQPQDRAGARASWMPMFQRRRRRDTHFPICIFCCGCCHRSKCGMCCKT

SEQ ID NO: 187 - DNA, 2359 bp, Homo Sapien
ctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggaattcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 188 - protein, 456 aa, Homo Sapien
MFLLLPFDSLIVNLLGISLTVLFTLLLVFIIVPAIFGVSFGIRKLYMKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCFLLPLRIALAFTGISLLVVGTTVVGYLPNGRFKEFMSKHVHLMCYRICVRALTAIITYHDRENRPRNGGICVANHTSPIDVIILASDGYYAMVGQVHGGLMGVIQRAMVKACPHVWFERSEVKDRHLVAKRLTEHVQDKSKLPILIFPEGTCINNTSVMMFKKGSFEIGATVYPVAIKYDPQFGDAFWNSSKYGMVTYLLRMMTSWAIVCSVWYLPPMTREADEDAVQFANRVKSAIARQGGLVDLLWDGGLKREKVKDTFKEEQQKLYSKMIVGNHKDRSRS

SEQ ID NO: 189 - DNA, 1103 bp, Homo Sapien
gcccctcgaaaccaggactccagcacctctggtcccgccctcacccggacccctggccctcacgtctcctccagggatggcgctggcggctttgatgatcgccctcggcagcctcggcctccacacctggcaggcccaggctgttcccaccatcctgcccctgggcctggctccagacacctttgacgatacctatgtgggttgtgcagaggagatggaggagaaggcagcccccctgctaaaggaggaaatggcccaccatgccctgctgcgggaatcctgggaggcagcccaggagacctgggaggacaagcgtcgagggcttaccttgccccctggcttcaaagcccagaatggaatagccattatggtctacaccaactcatcgaacaccttgtactgggagttgaatcaggccgtgcggacgggcggaggctcccgggagctctacatgaggcactttcccttcaaggccctgcatttctacctgatccgggccctgcagctgctgcgaggcagtgggggctgcagcaggggacctggggaggtggtgttccgaggtgtgggcagccttcgctttgaacccaagaggctgggggactctgtccgcttgggccagtttgcctccagctccctggataaggcagtggcccacagatttggggagaagaggcggggctgtgtgtctgcgccaggggtgcagctagggtcacaatctgagggggcctcctctctgcccccctggaagactctgctcttggcccctggagagttccagctctcaggggttgggccctgaaagtccaacatctgccacttaggagccctgggaacgggtgaccttcatatgacgaagaggcacctccagcagccttgagaagcaagaacatggttccggacccagccctagcagccttctccccaaccaggatgttggcctggggaggccacagcagggctgagggaactctgctatgtgatggggacttcctgggacaagcaaggaaagtactgaggcagccacttgattgaacggtgttgcaatgtggagacatggagttttattgaggtagctacgtgattaaatggtattgcagtgtgga

SEQ ID NO: 190 - protein, 240 aa, Homo Sapien
MALAALMIALGSLGLHTWQAQAVPTILPLGLAPDTFDDTYVGCAEEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGEKRRGCVSAPGVQLGSQSEGASSLPPWKTLLLAPGEFQLSGVGP

SEQ ID NO: 191 - DNA, 1076 bp, Homo Sapien
gtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctca

SEQ ID NO: 192 - protein, 335 aa, Homo Sapien
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 193 - DNA, 1969 bp, Homo Sapien
ggaggagggagggcgggcaggcgccagcccagagcagccccgggcaccagcacggactctctcttccagcccaggtgccccccactctcgctccattcggcgggagcacccagtcctgtacgccaaggaactggtcctgggggcaccatggtttcggcggcagcccccagcctcctcatccttctgttgctgctgctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccacaaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccacccagaacctcaagtcccccaccagggctgcactgggcggtggggacggagccaggatggtggagggcaggggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccaatcccagcatgtgctgattctacagcaggcagaaatgctggtccccggtgccccggaggaatcttaccaagtgccatcatccttcacctcagcagccccaaagggctacatcctacagcacagctcccctgacaaagtgagggagggcacgtgtccctgtgacagccaggataaaacatcccccaaagtgctgggattacaggcgtgagccaccgtgcccggcccaaactactttttaaaacagctacagggtaaaatcctgcagcacccactctggaaaatactgctcttaattttcctgaaggtggccccctgtttctagttggtccaggattagggatgtggggtatagggcatttaaatcctctcaagcgctctccaagcacccccggcctgggggtgagtttctcatcccgctactgctgctgggatcaggttgaatgaatggaactcttcctgtctggcctccaaagcagcctagaagctgaggggctgtgtttgaggggacctccaccctggggaagtccgaggggctggggaagggtttctgacgcccagcctggagcaggggggccctggccaccccctgttgctcacacattgtctggcagcctgtgtccacaatattcgtcagtcctcgacagggagcctgggctccgtcctgctttagggaggctctggcaggaggtcctctcccccatccctccatctggggctcccccaacctctgcacagctctccaggtgctgagatataatgcaccagcacaataaacctttattccggcctgaaaaaaaaaaaaaaaaaaaaaaaaaaaaaaaaaaaaaaaaaaaaaaaaaaaaaaaaga

SEQ ID NO: 194 - protein, 283 aa, Homo Sapien
MVSAAAPSLLILLLLLLGSVPATDARSVPLKATFLEDVAGSGEAEGSSASSPSLPPPWTPALSPTSMGPQPTTLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATQNLKSPTRAALGGGDGARMVEGRGAEEEEKGSQEGDQEVQGHGVPVETPEAQEEPCSGVLEGAVVAGEGQGELEGSLLLAQEAQGPVGPPESPCACSSVHPSV

SEQ ID NO: 195 - DNA, 860 bp, Homo Sapien
gaaagacgtggtcctgacagacagacaatcctattccctaccaaaatgaagatgctgctgctgctgtgtttgggactgaccctagtctgtgtccatgcagaagaagctagttctacgggaaggaactttaatgtagaaaagattaatggggaatggcatactattatcctggcctctgacaaaagagaaaagatagaagaacatggcaactttagactttttctggagcaaatccatgtcttggagaattccttagttcttaaagtccatactgtaagagatgaagagtgctccgaattatctatggttgctgacaaaacagaaaaggctggtgaatattctgtgacgtatgatggattcaatacatttactatacctaagacagactatgataactttcttatggctcacctcattaacgaaaaggatggggaaaccttccagctgatggggctctatggccgagaaccagatttgagttcagacatcaaggaaaggtttgcacaactatgtgaggagcatggaatccttagagaaaatatcattgacctatccaatgccaatcgctgcctccaggcccgagaatgaagaatggcctgagcctccagtgttgagtggacacttctcaccaggactccaccatcatcccttcctatccatacagcatccccagtataaattctgtgatctgcattccatcctgtctcactgagaagtccaattccagtctatcaacatgttacctaggatacctcatcaagaatcaaagacttctttaaatttctctttgatacacccttgacaatttttcatgaaattattcctcttcctgttcaataaatgattacccttgcacttaa

SEQ ID NO: 196 - protein, 180 aa, Homo Sapien
MKMLLLLCLGLTLVCVHAEEASSTGRNFNVEKINGEWHTIILASDKREKIEEHGNFRLFLEQIHVLENSLVLKVHTVRDEECSELSMVADKTEKAGEYSVTYDGFNTFTIPKTDYDNFLMAHLINEKDGETFQLMGLYGREPDLSSDIKERFAQLCEEHGILRENIIDLSNANRCLQARE

SEQ ID NO: 197 - DNA, 766 bp, Homo Sapien
ggctcgagcgtttctgagccaggggtgaccatgacctgctgcgaaggatggacatcctgcaatggattcagcctgctggttctactgctgttaggagtagttctcaatgcgatacctctaattgtcagcttagttgaggaagaccaattttctcaaaaccccatctcttgctttgagtggtggttcccaggaattataggagcaggtctgatggccattccagcaacaacaatgtccttgacagcaagaaaaagagcgtgctgcaacaacagaactggaatgtttctttcatcatttttcagtgtgatcacagtcattggtgctctgtattgcatgctgatatccatccaggctctcttaaaaggtcctctcatgtgtaattctccaagcaacagtaatgccaattgtgaattttcattgaaaaacatcagtgacattcatccagaatccttcaacttgcagtggtttttcaatgactcttgtgcacctcctactggtttcaataaacccaccagtaacgacaccatggcgagtggctggagagcatctagtttccacttcgattctgaagaaaacaaacataggcttatccacttctcagtatttttaggtctattgcttgttggaattctggaggtcctgtttgggctcagtcagatagtcatcggtttccttggctgtctgtgtggagtctctaagcgaagaagtcaaattgtgtagtttaatgggaataaaatgtaagtatcagtagtttgaaaaaaaaaaa

SEQ ID NO: 198 - protein, 229 aa, Homo Sapien [sequence omitted]

SEQ ID NO: 199 - DNA, 636 bp, Homo Sapien
atccgttctctgcgctgccagctcaggtgagccctcgccaaggtgacctcgcaggacactggtgaaggagcagtgaggaacctgcagagtcacacagttgctgaccaattgagctgtgagcctggagcagatccgtgggctgcagacccccgccccagtgcctctccccctgcagccctgcccctcgaactgtgacatggagagagtgaccctggcccttctcctactggcaggcctgactgccttggaagccaatgacccatttgccaataaagacgatcccttctactatgactggaaaaacctgcagctgagcggactgatctgcggagggctcctggccattgctgggatcgcggcagttctgagtggcaaatgcaaatacaagagcagccagaagcagcacagtcctgtacctgagaaggccatcccactcatcactccaggctctgccactacttgctgagcacaggactggcctccagggatggcctgaagcctaacactggcccccagcacctcctcccctgggaggccttatcctcaaggaaggacttctctccaagggcaggctgttaggcccctttctgatcaggaggcttctttatgaattaaactcgccccaccaccccctca

SEQ ID NO: 200 - protein, 89 aa, Homo Sapien [sequence omitted]

SEQ ID NO: 201 - DNA, 1734 bp, Homo Sapien
gtggactctgagaagcccaggcagttgaggacaggagagagaaggctgcagacccagagggagggaggacagggagtcggaaggaggaggacagaggagggcacagagacgcagagcaagggcggcaaggaggagaccctggtgggaggaagacactctggagagagagggggctgggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgcagcagatgctttgggcaacagggtcggggaagcagcccatgctctgggaaacactgggcacgagattggcagacaggcagaagatgtcattcgacacggagcagatgctgtccgcggctcctggcagggggtgcctggccacagtggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatcgggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 202 - protein, 440 aa, Homo Sapien
MKFQGPLACLLLALCLGSGEAGPLQSGEESTGTNIGEALGHGLGDALSEGVGKAIGKEAGGAAGSKVSEALGQGTREAVGTGVRQVPGFGAADALGNRVGEAAHALGNTGHEIGRQAEDVIRHGADAVRGSWQGVPGHSGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGSSSGGSSGGSSGGSSGNSGGSRGDSGSESSWGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKDQRSSRIP

SEQ ID NO: 203 - DNA, 1676 bp, Homo Sapien
ggagaagaggttgtgtgggacaagctgctcccgacagaaggatgtcgctgctgagcctgccctggctgggcctcagaccggtggcaatgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaaggactcgacccagatgtcggccacctattcccagggctttacggtatggctgggtcccatcatccccttcatcgttttatgccaccctgacaccatccggtctatcaccaatgcctcagctgccattgcacccaaggataatctcttcatcaggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagtcgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtctacgaccccttccgctttgacccagagaacagcaaggggaggtcacctctggcttttattcctttctccgcagggcccaggaactgcatcgggcaggcgttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaggcttgcagtgactttctgacccatccacctgtttttttgcagattgtcatgaataaaacggtgctgtcaaa

SEQ ID NO: 204 - protein, 524 aa, Homo Sapien
MSLLSLPWLGLRPVAMSPWLLLLLVVGSWLLARILAWTYAFYNNCRRLQCFPQPPKRNWFWGHLGLITPTEEGLKDSTQMSATYSQGFTVWLGPIIPFIVLCHPDTIRSITNASAAIAPKDNLFIRFLKPWLGEGILLSGGDKWSRHRRMLTPAFHFNILKSYITIFNKSANIMLDKWQHLASEGSSRLDMFEHISLMTLDSLQKCIFSFDSHCQERPSEYIATILELSALVEKRSQHILQHMDFLYYLSHDGRRFHRACRLVHDFTDAVIRERRRTLPTQGIDDFFKDKAKSKTLDFIDVLLLSKDEDGKALSDEDIRAEADTFMFGGHDTTASGLSWVLYNLARHPEYQERCRQEVQELLKDRDPKEIEWDDLAQLPFLTMCVKESLRLHPPAPFISRCCTQDIVLPDGRVIPKGITCLIDIIGVHHNPTVWPDPEVYDPFRFDPENSKGRSPLAFIPFSAGPRNCIGQAFAMAEMKVVLALMLLHFRFLPDHTEPRRKLELIMRAEGGLWLRVEPLNVGLQ

SEQ ID NO: 205 - DNA, 2401 bp, Homo Sapien
tcccttgacaggtctggtggctggttcggggtctactgaaggctgtcttgatcaggaaactgaagactctctgcttttgccacagcagttcctgcagcttccttgaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggaaaaaaaaaaaaaaaaaaaaaaaaaaaaaaaaaaaaaaaa

SEQ ID NO: 206 - protein, 299 aa, Homo Sapien
MSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 207 - DNA, 2694 bp, Homo Sapien
gtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatctattttaaaaaaaaaa

SEQ ID NO: 208 - protein, 131 aa, Homo Sapien
MAGIKALISLSFGGAIGLMFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 209 - DNA, 1172 bp, Homo Sapien
cttgcagagaaagagtcttttgtgcagcaccctttaaagggtgactcgtcccacttgtgttctctctcctggtgcagagttgcaagcaagtttatcagagtatcgccatgaagttcgtcccctgcctcctgctggtgaccttgtcctgcctggggactttgggtcaggccccgaggcaaaagcaaggaagcactggggaggaattccatttccagactggagggagagattcctgcactatgcgtcccagcagcttggggcaaggtgctggagaagtctggcttcgcgtcgactgccgcaacacagaccagacctactggtgtgagtacagggggcagcccagcatgtgccaggcttttgctgctgaccccaaaccttactggaatcaagccctgcaggagctgaggcgccttcaccatgcgtgccagggggccccggtgcttaggccatccgtgtgcagggaggctggaccccaggcccatatgcagcaggtgacttccagcctcaagggcagcccagagcccaaccagcagcctgaggctgggacgccatctctgaggcccaaggccacagtgaaactcacagaagcaacacagctgggaaaggactcgatggaagagctgggaaaagccaaacccaccacccgacccacagccaaacctacccagcctggacccaggcccggagggaatgaggaagcaaagaagaaggcctgggaacattgttggaaacccttccaggccctgtgcgcctttctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgtgtgcaaaataaaagaatgatttcagaaaaaaaaa

SEQ ID NO: 210 - protein, 223 aa, Homo Sapien
MKFVPCLLLVTLSCLGTLGQAPRQKQGSTGEEFHFQTGGRDSCTMRPSSLGQGAGEVWLRVDCRNTDQTYWCEYRGQPSMCQAFAADPKPYWNQALQELRRLHHACQGAPVLRPSVCREAGPQAHMQQVTSSLKGSPEPNQQPEAGTPSLRPKATVKLTEATQLGKDSMEELGKAKPTTRPTAKPTQPGPRPGGNEEAKKKAWEHCWKPFQALCAFLISFFRG

SEQ ID NO: 211 - DNA, 708 bp, Homo Sapien
gtgcaaggagccgaggcgagatgggcgtcctgggccgggtcctgctgtggctgcagctctgcgcactgacccaggcggtctccaaactctgggtccccaacacggacttcgacgtcgcagccaactggagccagaaccggaccccgtgcgccggcggcgccgttgagttcccggcggacaagatggtgtcagtcctggtgcaagaaggtcacgccgtctcagacatgctcctgccgctggatggggaactcgtcctggcttcaggagccggattcggcgtctcagacgtgggctcgcacctggactgtggcgcgggcgaacctgccgtcttccgcgactctgaccgcttctcctggcatgaccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccggacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggcgcagccgtggatctgcgcggccctgctccagcccct

SEQ ID NO: 212 - protein, 197 aa, Homo Sapien
MGVLGRVLLWLQLCALTQAVSKLWVPNTDFDVAANWSQNRTPCAGGAVEFPADKMVSVLVQEGHAVSDMLLPLDGELVLASGAGFGVSDVGSHLDCGAGEPAVFRDSDRFSWHDRTCGALGTRHLASSSWTPSACPAATTTSSFRLVPPSAWGSALALAPCVSAASRLWAGRSRATRTWLFSWRPARAAYASTGRAR

SEQ ID NO: 213 - DNA, 644 bp, Homo Sapien
atcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcaaaaaaaaaaaaaaaaaaaaaaaaaaaaaaaaaaaaaaaaaaaaaaaaaaaaaaaaaaaaaaaaaaaaaaa

SEQ ID NO: 214 - protein, 77 aa, Homo Sapien
MGPVKQLKRMFEPTRLIATIMVLLCFALTLCSAFWWHNKGLALIFCILQSLALTWYSLSFIPFARDAVKKCFAVCLA

SEQ ID NO: 215 - DNA, 1337 bp, Homo Sapien
ggatttttgtgatccgcgattcgctcccacgggcgggacctttgtaactgcgggaggcccaggacaggcccaccctgcggggcgggaggcagccggggtgagggaggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctgagttctttcaccacaagtttgagatcctggatgcccgtcgtggtggtggtctcattcatcctggacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaagcccctggactgatgagtttgctgtatcaacctgtaaggagaagctctctccggatggctatgggaatgaaagaatccgacttctactctcacacagccaccgtgaaagtcctggagtaaaatgtgctgtgtacagaagagagagaaggaagcaggctggcatgttcactgggctggtgttacgacagagaacctgacagtcactggccagttatcacttcagattacaaatcacacagagcatctgcctgttttcaatcacaagagaacaaaaccaaaatctataaagatattctgaaaatatgacagaatttgacaaataaaagcataaacgtgtaaaaaaaaaaaaaaaaaaaaaaaaaaaaaaaaaaaa

SEQ ID NO: 216 - protein, 255 aa, Homo Sapien
MATWDEKAVTRRAKVAPAERMSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLSSFTTSLRSWMPVVVVVSFILDIVLLFQEHQFEALGLLILLRLWRVARIINGIIISVKTRSERQLLRLKQMNVQLAAKIQHLEFSCSEKPLD

SEQ ID NO: 217 - DNA, 1658 bp, Homo Sapien
ggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgccttggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggggacaccgattttataaataaactgagcaccttctttttaaacaaaaaaaaaaaaaaaaaaaaaaaaaaaaaaaaaaaaaaaaaaaaaaaaaaaa

SEQ ID NO: 218 - protein, 282 aa, Homo Sapien
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 219 - DNA, 1484 bp, Homo Sapien
gaatttgtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgtaagttagactactgcgagtgcgggacgcagctctgtggatctcgacatacctgtgttagttccttcccagaacccatctccccagagtgggtgaggacacggccttttcccatcctgccctttcctctgcagctgttttgcttccttgtggccatcagagttcccttcccctggacagtctggagaaagacagaggctggggtttgggattgaagaccagaccccatctgagcccttcctccagccctgtaccagctcctactggcatggctgagctcagaccctcctgatttctgcctattatcccaggagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatgtaaacagacaaaaaaaaaaaaaaaaaaaaaaaaaaaaaaaaaaaaaaaaaaaaaaaaaaaaaaaaaaaaaaaaaaaaaa

SEQ ID NO: 220 - protein, 180 aa, Homo Sapien
MAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRKLDYCECGTQLCGSRHTCVSSFPEPISPEWVRTRPFPILPFPLQLFCFLVAIRVPFPWTVWRKTEAGVWD

SEQ ID NO: 221 - DNA, 1164 bp, Homo Sapien
cttctgtaggacagtcaccaggccagatccagaagcctctctaggctccagctttctctgtggaagatgacagcaattatagcaggaccctgccaggctgtcgaaaagattccgcaataaaactttgccagtgggaagtacctagtgaaacggcctaagatgccacttcttctcatgtcccaggcttgaggccctgtggtccccatccttgggagaagtcagctccagcaccatgaagggcatcctcgttgctggtatcactgcagtgcttgttgcagctgtagaatctctgagctgcgtgcagtgtaattcatgggaaaaatcctgtgtcaacagcattgcctctgaatgtccctcacatgccaacaccagctgtatcagctcctcagccagctcctctctagagacaccagtcagattataccagaatatgttctgctcagcggagaactgcagtgaggagacacacattacagccttcactgtccacgtgtctgctgaagaacactttcattttgtaagccagtgctgccaaggaaaggaatgcagcaacaccagcgatgccctggaccctcccctgaagaacgtgtccagcaacgcagagtgccctgcttgttatgaatctaatggaacttcctgtcgtgggaagccctggaaatgctatgaagaagaacagtgtgtctttctagttgcagaacttaagaatgacattgagtctaagagtctcgtgctgaaaggctgttccaacgtcagtaacgccacctgtcagttcctgtctggtgaaaacaagactcttggaggagtcatctttcgaaagtttgagtgtgcaaatgtaaacagcttaacccccacgtctgcaccaaccacttcccacaacgtgggctccaaagcttccctctacctcttggcccttgccagcctccttcttcggggactgctgccctgaggtcctggggctgcactttgcccagcaccccatttctgcttctctgaggtccagagcaccccctgcggtgctgacaccctctttccctgctctgccccgtttaactgcccagtaagtgggagtcacaggtctccaggcaatgccgacagctgccttgttcttcattattaaagcactggttcattcactgccaaaaaaaaaaaaaaaaaaaaaaaaaa

SEQ ID NO: 222 - protein, 237 aa, Homo Sapien
MKGILVAGITAVLVAAVESLSCVQCNSWEKSCVNSIASECPSHANTSCISSSASSSLETPVRLYQNMFCSAENCSEETHITAFTVHVSAEEHFHFVSQCCQGKECSNTSDALDPPLKNVSSNAECPACYESNGTSCRGKPWKCYEEEQCVFLVAELKNDIESKSLVLKGCSNVSNATCQFLSGENKTLGGVIFRKFECANVNSLTPTSAPTTSHNVGSKASLYLLALASLLLRGLLP

SEQ ID NO: 223 - DNA, 1245 bp, Homo Sapien
ggcctcggttcaaacgacccggtgggtctacagcggaagggagggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacaa

SEQ ID NO: 224 - protein, 341 aa, Homo Sapien
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPSPEDLRLVLMPWGPWHCHCKSGTMSRSRSGKLHGLSGRLRVGALSQLRTEHKPCTYQQCPCNRLREECPLDTSLCTDTNCASQSTTSTRTTTTPFPTIHLRSSPSLPPASPCPALAFWKRVRIGLEDIWNSLSSVFTEMQPIDRNQR

SEQ ID NO: 225 - DNA, 2692 bp, Homo Sapien
cccgggtcgacccacgcgtccggggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctgggtgtccctcaatgcatggttctggtccacagtcttccacaccagggacactgacctcacagagaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgttcttagctctaccgggaggacagctgcctgtttcctccccaccagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccgttgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaagacgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgtgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctcaaaaaaaaaaaaaaaaa

SEQ ID NO: 226 - protein, 320 aa, Homo Sapien
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLTEKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 227 - DNA, 2136 bp, Homo Sapien
ttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaagggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaaaaaaaaaaaaaaaaaaaaaaaaaaaaaaaaaaaaaaaaaaaaaaaaaaaaaaaaaaaaaaaaaaaaaaaaa

SEQ ID NO: 228 - protein, 247 aa, Homo Sapien
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCKD

SEQ ID NO: 229 - DNA, 1661 bp, Homo Sapien
  unsure 678: unknown base
cgggaggctgggtcgtcatgatccggaccccattgtcggcctctgcccatcgcctgctcctcccaggctcccgcggccgacccccgcgcaacatgcagcccacgggccgcgagggttcccgcgcgctcagccggcggtatctgcggcgtctgctgctcctgctactgctgctgctgctgcggcagcccgtaacccgcgcggagaccacgccgggcgcccccagagccctctccacgctgggctcccccagcctcttcaccacgccgggtgtccccagcgccctcactaccccaggcctcactacgccaggcacccccaaaaccctggaccttcggggtcgcgcgcaggccctgatgcggagtttcccactcgtggacggccacaatgacctgccccaggtcctgagacagcgttacaagaatgtgcttcaggatgttaacctgcgaaatttcagccatggtcagaccagcctggacaggcttagagacggcctcgtgggtgcccagttctggtcagcctccgtctcatgccagtcccaggaccagactgccgtgcgcctcgccctggagcagattgacctcattcaccgcatgtgtgcctcctactctgaactcgagcttgtgacctcagctgaaggtctgaacagctctcaaaagctggcctgcctcattggcgtgnagggtggtcactcactggacagcagcctctctgtgctgcgcagtttctatgtgctgggggtgcgctacctgacacttaccttcacctgcagtacaccatgggcagagagttccaccaagttcagacaccacatgtacaccaacgtcagcggattgacaagctttggtgagaaagtagtagaggagttgaaccgcctgggcatgatgatagatttgtcctatgcatcggacaccttgataagaagggtcctggaagtgtctcaggctcctgtgatcttctcccactcagctgccagagctgtgtgtgacaatttgttgaatgttcccgatgatatcctgcagcttctgaagaacggtggcatcgtgatggtgacactgtccatgggggtgctgcagtgcaacctgcttgctaacgtgtccactgtggcagatcactttgaccacatcagggcagtcattggatctgagttcatcgggattggtggaaattatgacgggactggccggttccctcaggggctggaggatgtgtccacatacccagtcctgatagaggagttgctgagtcgtasctggagcgaggaagagcttcaaggtgtccttcgtggaaacctgctgcgggtcttcagacaagtggaaaaggtgagagaggagagcagggcgcagagccccgtggaggctgagtttccatatgggcaactgagcacatcctgccactcccacctcgtgcctcagaatggacaccaggctactcatctggaggtgaccaagcagccaaccaatcgggtcccctggaggtcctcaaatgcctccccataccttgttccaggccttgtggctgctgccaccatcccaaccttcacccagtggctctgctgacacagtcggtccccgcagaggtcactgtggcaaagcctcacaaagccccctctcctagttcattcacaagcatatgctgagaataaacatgttacacatggaaaa

SEQ ID NO: 230 - protein, 487 aa, Homo Sapien
  unsure 196, 386: unknown amino acid
MQPTGREGSRALSRRYLRRLLLLLLLLLLRQPVTRAETTPGAPRALSTLGSPSLFTTPGVPSALTTPGLTTPGTPKTLDLRGRAQALMRSFPLVDGHNDLPQVLRQRYKNVLQDVNLRNFSHGQTSLDRLRDGLVGAQFWSASVSCQSQDQTAVRLALEQIDLIHRMCASYSELELVTSAEGLNSSQKLACLIGVXGGHSLDSSLSVLRSFYVLGVRYLTLTFTCSTPWAESSTKFRHHMYTNVSGLTSFGEKVVEELNRLGMMIDLSYASDTLIRRVLEVSQAPVIFSHSAARAVCDNLLNVPDDILQLLKNGGIVMVTLSMGVLQCNLLANVSTVADHFDHIRAVIGSEFIGIGGNYDGTGRFPQGLEDVSTYPVLIEELLSRXWSEEELQGVLRGNLLRVFRQVEKVREESRAQSPVEAEFPYGQLSTSCHSHLVPQNGHQATHLEVTKQPTNRVPWRSSNASPYLVPGLVAAATIPTFTQWLC

SEQ ID NO: 231 - DNA, 1095 bp, Homo Sapien
gctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctgaa

SEQ ID NO: 232 - protein, 153 aa, Homo Sapien
MAAGLFGLSARRLLAAAATRGLPAARVRWESSFSRTVVAPSAVAGKRPPEPTTPWQEDPEPEDENLYEKNPDSHGYDKDPVLDVWNMRLVFFFGVSIILVLGSTFVAYLPDYRMKEWSRREAERLVKYREANGLPIMESNCFDPSKIQLPEDE

SEQ ID NO: 233 - DNA, 2162 bp, Homo Sapien
gcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtggaaaaaaaaaaaa

SEQ ID NO: 234 - protein, 574 aa, Homo Sapien
MPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 235 - DNA, 1617 bp, Homo Sapien
tgacgtcagaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacatccggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccccctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctga

SEQ ID NO: 236 - protein, 284 aa, Homo Sapien
MASYPYRQGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 237 - DNA, 1234 bp, Homo Sapien
caggatgcagggccgcgtggcagggagctgcgctcctctgggcctgctcctggtctgtcttcatctcccaggcctctttgcccggagcatcggtgttgtggaggagaaagtttcccaaaacttcgggaccaacttgcctcagctcggacaaccttcctccactggcccctctaactctgaacatccgcagcccgctctggaccctaggtctaatgacttggcaagggttcctctgaagctcagcgtgcctccatcagatggcttcccacctgcaggaggttctgcagtgcagaggtggcctccatcgtgggggctgcctgccatggattcctggccccctgaggatccttggcagatgatggctgctgcggctgaggaccgcctgggggaagcgctgcctgaagaactctcttacctctccagtgctgcggccctcgctccgggcagtggccctttgcctggggagtcttctcccgatgccacaggcctctcacctgaggcttcactcctccaccaggactcggagtccagacgactgccccgttctaattcactgggagccgggggaaaaatcctttcccaacgccctccctggtctctcatccacagggttctgcctgatcacccctggggtaccctgaatcccagtgtgtcctggggaggtggaggccctgggactggttggggaacgaggcccatgccacaccctgagggaatctggggtatcaataatcaacccccaggtaccagctggggaaatattaatcggtatccaggaggcagctggggaaatattaatcggtatccaggaggcagctgggggaatattaatcggtatccaggaggcagctgggggaatattcatctatacccaggtatcaataacccatttcctcctggagttctccgccctcctggctcttcttggaacatcccagctggcttccctaatcctccaagccctaggttgcagtggggctagagcacgatagagggaaacccaacattgggagttagagtcctgctcccgccccttgctgtgtgggctcaatccaggccctgttaacatgtttccagcactatccccacttttcagtgcctcccctgctcatctccaataaaataaaagcacttatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 238 - protein, 325 aa, Homo Sapien [sequence omitted]

SEQ ID NO: 239 - DNA, 1738 bp, Homo Sapien
gggcgtctccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgccccaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatggtgagcgccggctccggccgcagaggctggcaccgggggtggggcctgggccaccagcctgctctgttccccagccagctctgttccccagccagtgcgtgtgatggctggctcagggtctcctctggcaggggaggatcccggctctgttctgttttgtttgtttgttttgagacagggtctcactctgccactgacgctggagtgcaatggcacaatcgtcatgccctgaaaccttagactcccggggttaagcgatcctgcttcagcctcccaagtagctggaactacaggcatgcaccatggtgcccagctagattttaaatattttgtggagatgggggtcttgctacgttgcccaggctggtcttgaactcctaggctcaagcaatcctcctgcctcagcctctcaaagtgctaggattataggcatgagtcaccctgtctggctctggctctgttcttaacattctgccaaaacaacacacgtgggttccctgtgcagagcctgcctcgttgccttcatgtcactcttggtagctccactgggaacacagctctcagcctttcccacctggaggcagagtggggaggggcccagggctgggctttgctgatgctgatctcagctgtgccacacgctagctgcaccaccctgacttctccttagcccgtgtgagcctcactttccacttggagagtccttcctcgcgtggttgccatgactgtgagataagtcgaggctgtgaagggcccggcacagactgacctgcctccccaacccctaggctttgctaaccgggaaaggagctaacggtgacagaagacagccaaggtcaaccctcccgggtgattgtgatgggtgttccaggtgtggttgggcgatgctgctacttgaccccaagctccagtgtggaaacttccttcctggctggttttccagaactacagaggaatggaccacagtcttccagggtccctcctcgtccaccaaccgggagcctccaccttggccatccgtcagctatgaatggctttttaaacaaacccacgtcccagcctgggtaacatggtaaagccccgtctctacaaaaaaatccaagttagccgggcatggtggtgcgcacctgtagtcccagctgcagtgggactgaggtggaggtggaggtggggggtgggagctgaggaaggaggatcgcttgagcctgggaagtcgaggctgcagtgagctgagattgcaccactgcactccagcctgggtgacagagcaagaccctgtctcaaaaa

SEQ ID NO: 240 - protein, 159 aa, Homo Sapien
MSCVLGGVIPLGLLFLVCGSQGYLLPNVTLLEELLSKYQHNESHSRVRRAIPREDKEEILMLHNKLRGQVQPQASNMEYMVSAGSGRRGWHRGWGLGHQPALFPSQLCSPASACDGWLRVSSGRGGSRLCSVLFVCFETGSHSATDAGVQWHNRHALKP

SEQ ID NO: 241 - DNA, 422 bp, Homo Sapien
aaggagaggccaccgggacttcagtgtctcctccatcccaggagcgcagtggccactatggggtctgggctgccccttgtcctcctcttgaccctccttggcagctcacatggaacagggccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgaccctgtctttcagcaggcccccaccctcctgagtggcaataaataaaattcggtatgctg

SEQ ID NO: 242 - protein, 78 aa, Homo Sapien
MGSGLPLVLLLTLLGSSHGTGPGMTLQLKLKESFLTNSSYESSFLELLEKLCLLLHLPSGTSVTLHHARSQHHVVCNT

SEQ ID NO: 243 - DNA, 508 bp, Homo Sapien
ggcaagtggaaccactggcttggtggattttgctagatttttctgatttttaaactcctgaaaaatatcccagataactgtcatgaagctggtaactatcttcctgctggtgaccatcagcctttgtagttactctgctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtgacatcaagataaagagcggaggtggatggggatggaagatgatgctcctatcctccctgcctgaaacctgttctaccaattatagatcaaatgccctaaaatgtagtgacccgtgaaaaggacaaataaagcaatgaatacatta

SEQ ID NO: 244 - protein, 93 aa, Homo Sapien
MKLVTIFLLVTISLCSYSATAFLINKVPLPVDKLAPLPLDNILPFMDPLKLLLKTLGISVEHLVEGLRKCVNELGPEASEAVKKLLEALSHLV

SEQ ID NO: 245 - DNA, 1564 bp, Homo Sapien
tgctaggctctgtcccacaatgcacccgagagcaggagctgaaagcctctaacacccacagatccctctatgactgcaatgtgaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccggcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 246 - protein, 183 aa, Homo Sapien
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 247 - DNA, 826 bp, Homo Sapien
aattgtatctgtgtaatgttaaaacaaacgaaataaaatagaaggaaaaactttctgagtttcaaaaacaacagactagtactctaaagaactctttaaaacaattaactgttaggattgcagttatgattggatattatttaattctgtttctgatgtggggttcctccactgtgttctgtgtgctattaatatttaccattgcagaagcttcattcagtgttgaaaatgaatgcttagtggatctgtgcctcttacgcatatgttacaaattatctggagttcctaatcaatgcagagttcccctcccctccgattgttctaaataattgaaagatgtctgctgtggaaaaaggcatgtatttaaatctgtatgattctcaaccatctttagttgggaaaggtccttgaaagccaatggaaatactttttttttttcttggcactaatcaagtgagtgttaccttttcacttagtaggatgtgttgttacgctagtaaaatagaaacctgtgtttattctcaggtattttagaaacaacagccatcattttattttatgtgtgtgttcttggctgtattcataaattatatattttgggctatcaaatattacttcattcaatataaataacaatagtagaagttgtttacttagatatgctttctagttgcattttctcagcctatgtaagactactttgttgtaatagcctttgaaatttacagtactgtctctctactatcttcagattacttgattcaaataaaccaattatgtttgtaattgatattaataaaaccagaataaaagttcatatctaccc

SEQ ID NO: 248 - protein, 67 aa, Homo Sapien
MIGYYLILFLMWGSSTVFCVLLIFTIAEASFSVENECLVDLCLLRICYKLSGVPNQCRVPLPSDCSK

SEQ ID NO: 249 - DNA, 3170 bp, Homo Sapien
agcgggtctcgcttgggttccgctaatttctgtcctgaggcgtgagactgagttcatagggtcctgggtccccgaaccaggaagggttgagggaacacaatctgcaagcccccgcgacccaagtgaggggccccgtgttggggtcctccctccctttgcattcccacccctccgggctttgcgtcttcctggggaccccctcgccgggagatggccgcgttgatgcggagcaaggattcgtcctgctgcctgctcctactggccgcggtgctgatggtggagagctcacagatcggcagttcgcgggccaaactcaactccatcaagtcctctctgggcggggagacgcctggtcaggccgccaatcgatctgcgggcatgtaccaaggactggcattcggcggcagtaagaagggcaaaaacctggggcaggcctacccttgtagcagtgataaggagtgtgaagttgggaggtattgccacagtccccaccaaggatcatcggcctgcatggtgtgtcggagaaaaaagaagcgctgccaccgagatggcatgtgctgccccagtacccgctgcaataatggcatctgtatcccagttactgaaagcatcttaacccctcacatcccggctctggatggtactcggcacagagatcgaaaccacggtcattactcaaaccatgacttgggatggcagaatctaggaagaccacacactaagatgtcacatataaaagggcatgaaggagacccctgcctacgatcatcagactgcattgaagggttttgctgtgctcgtcatttctggaccaaaatctgcaaaccagtgctccatcagggggaagtctgtaccaaacaacgcaagaagggttctcatgggctggaaattttccagcgttgcgactgtgcgaagggcctgtcttgcaaagtatggaaagatgccacctactcctccaaagccagactccatgtgtgtcagaaaatttgatcaccattgaggaacatcatcaattgcagactgtgaagttgtgtatttaatgcattatagcatggtggaaaataaggttcagatgcagaagaatggctaaaataagaaacgtgataagaatatagatgatcacaaaaagggagaaagaaaacatgaactgaatagattagaatgggtgacaaatgcagtgcagccagtgtttccattatgcaacttgtctatgtaaataatgtacacatttgtggaaaatgctattattaagagaacaagcacacagtggaaattactgatgagtagcatgtgactttccaagagtttaggttgtgctggaggagaggtttccttcagattgctgattgcttatacaaataacctacatgccagatttctattcaacgttagagtttaacaaaatactcctagaataacttgttatacaataggttctaaaaataaaattgctaaacaagaaatgaaaacatggagcattgttaatttacaacagaaaattaccttttgatttgtaacactacttctgctgttcaatcaagagtcttggtagataagaaaaaaatcagtcaatatttccaaataattgcaaaataatggccagttgtttaggaaggcctttaggaagacaaataaataacaaacaaacagccacaaatacttttttttcaaaattttagttttacctgtaattaataagaactgatacaagacaaaaacagttccttcagattctacggaatgacagtatatctctctttatcctatgtgattcctgctctgaatgcattatattttccaaactatacccataaattgtgactagtaaaatacttacacagagcagaattttcacagatggcaaaaaaatttaaagatgtccaatatatgtgggaaaagagctaacagagagatcattatttcttaaagattggccataacctatattttgatagaattagattggtaaatacatgtattcatacatactctgtggtaatagagacttaagctggatctgtactgcactggagtaagcaagaaaattgggaaaactttttcgtttgttcaggttttggcaacacatagatcatatgtctgaggcacaagttggctgttcatctttgaaaccaggggatgcacagtctaaatgaatatctgcatgggatttgctatcataatatttactatgcagatgaattcagtgtgaggtcctgtgtccgtactatcctcaaattatttattttatagtgctgagatcctcaaataatctcaatttcaggaggtttcacaaaatgtactcctgaagtagacagagtagtgaggtttcattgccctctataagcttctgactagccaatggcatcatccaattttcttcccaaacctctgcagcatctgctttattgccaaagggctagtttcggttttctgcagccattgcggttaaaaaatataagtaggataacttgtaaaacctgcatattgctaatctatagacaccacagtttctaaattctttgaaaccactttactactttttttaaacttaactcagttctaaatactttgtctggagcacaaaacaataaaaggttatcttatagtcgtgactttaaacttttgtagaccacaattcactttttagttttcttttacttaaatcccatctgcagtctcaaatttaagttctcccagtagagattgagtttgagcctgtatatctattaaaaatttcaacttcccacatatatttactaagatgattaagacttacattttctgcacaggtctgcaaaaacaaaaattataaactagtccatccaagaaccaaagtttgtataaacaggttgctataagcttgtgaaatgaaaatggaacatttcaatcaaacatttcctatataacaattattatatttacaatttggtttctgcaatatttttcttatgtccacccttttaaaaattattatttgaagtaatttatttacaggaaatgttaatgagatgtattttcttatagagatatttcttacagaaagctttgtagcagaatatatttgcagctattgactttgtaatttaggaaaaatgtataataagataaaatctattaaatttttctcctctaaaaactgaaaaaaaaaaaaaaaaaaaaaaaaaaaaaaa

SEQ ID NO: 250 - protein, 259 aa, Homo Sapien
MAALMRSKDSSCCLLLLAAVLMVESSQIGSSRAKLNSIKSSLGGETPGQAANRSAGMYQGLAFGGSKKGKNLGQAYPCSSDKECEVGRYCHSPHQGSSACMVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 251 - DNA, 1809 bp, Homo Sapien
tctcaatctgctgacctcgtgatccgcctgaccttgtaatccacctaccttggcctcccaaagtgttgggattacaggcgtgagccaccgcgcccggccaacatcacgtttttaaaaattgatttcttcaaattcatggcaaatatttcccttccctttaacttcttatgtcagaatgaggaaggatagctgcatttatttagtcagttttcattgcatagtaatattttcatgtagtattttctaagttatattttagtaattcatatgttttagattataggttttaacatacttgtgaaaatacttgatgtgttttaaagccttgggcagaaattctgtattgttgaggatttgttcttttatcccccttttaaagtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacagtaagtatagcagcaagctactcttgtcatggctggtgccaaccaaacagaggaagaggatagctcacgtgatgtggaaaacaccagttggtcaatggctcattcgttaaaaagcagcccttttgcttttttgtttttggaccaggtgttggctgtggtgttattagaaatgtcttaaccacagcaagaaggaggtggtggtctcatattcttctgccctaatcagactgcaccacaagtgcagcatacagtatgcattttaaagatgcttgggccaggcggggtggctgatgcccataatcccagtgctttggggggccaaggcaggcagattgcccaagctcaggagtttgagaccaccctgggcaacatggtgaaactctgtctctactaaaatacgaaaaactagccgggtgtggtggcggcgcgtgcctgtaatcccagctacttgggaggctgaggcacaagaatcgcttgagccagcttgggctacaaagtgagactccgtctgaaaaga

SEQ ID NO: 252 - protein, 363 aa, Homo Sapien
MCFKALGRNSVLLRICSFIPLLKSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDSKYSSKLLLSWLVPTKQRKRIAHVMWKTPVGQWLIR

SEQ ID NO: 253 - DNA, 2281 bp, Homo Sapien
gggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaaaaaaaaaaaaaaaaaaaaaaaaaaaaaaaaaaaaaaaaaaaaaaaaaaaaaaa

SEQ ID NO: 254 - protein, 447 aa, Homo Sapien
MELSQMSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 255 - DNA, 744 bp, Homo Sapien
acggaccgagggttcgagggagggacacggaccaggaacctgagctaggtcaaagacgcccgggccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccggaagccatcactgctatcatcgtggtcttctccctcttggctgccttgctcctggctgtggggctggcactgttggtgcggaagcttcgggagaagcggcagacggagggcacctaccggcccagtagcgaggagcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgtaaaaaaaaaaaaaaaaaa

SEQ ID NO: 256 - protein, 123 aa, Homo Sapien
MANPGLGLLLALGLPFLLARWGRAWGQIQTTSANENSTVLPSSTSSSSDGNLRPEAITAIIVVFSLLAALLLAVGLALLVRKLREKRQTEGTYRPSSEEQFSHAAEARAPQDSKETVQGCLPI

SEQ ID NO: 257 - DNA, 3265 bp, Homo Sapien
gccaggaataactagagaggaacaatggggttattcagaggttttgttttcctcttagttctgtgcctgctgcaccagtcaaatacttccttcattaagctgaataataatggctttgaagatattgtcattgttatagatcctagtgtgccagaagatgaaaaaataattgaacaaatagaggatatggtgactacagcttctacgtacctgtttgaagccacagaaaaaagattttttttcaaaaatgtatctatattaattcctgagaattggaaggaaaatcctcagtacaaaaggccaaaacatgaaaaccataaacatgctgatgttatagttgcaccacctacactcccaggtagagatgaaccatacaccaagcagttcacagaatgtggagagaaaggcgaatacattcacttcacccctgaccttctacttggaaaaaaacaaaatgaatatggaccaccaggcaaactgtttgtccatgagtgggctcacctccggtggggagtgtttgatgagtacaatgaagatcagcctttctaccgtgctaagtcaaaaaaaatcgaagcaacaaggtgttccgcaggtatctctggtagaaatagagtttataagtgtcaaggaggcagctgtcttagtagagcatgcagaattgattctacaacaaaactgtatggaaaagattgtcaattctttcctgataaagtacaaacagaaaaagcatccataatgtttatgcaaagtattgattctgttgttgaattttgtaacgaaaaaacccataatcaagaagctccaagcctacaaaacataaagtgcaattttagaagtacatgggaggtgattagcaattctgaggattttaaaaacaccatacccatggtgacaccacctcctccacctgtcttctcattgctgaagatcagtcaaagaattgtgtgcttagttcttgataagtctggaagcatggggggtaaggaccgcctaaatcgaatgaatcaagcagcaaaacatttcctgctgcagactgttgaaaatggatcctgggtggggatggttcactttgatagtactgccactattgtaaataagctaatccaaataaaaagcagtgatgaaagaaacacactcatggcaggattacctacatatcctctgggaggaacttccatctgctctggaattaaatatgcatttcaggtgattggagagctacattcccaactcgatggatccgaagtactgctgctgactgatggggaggataacactgcaagttcttgtattgatgaagtgaaacaaagtggggccattgttcattttattgctttgggaagagctgctgatgaagcagtaatagagatgagcaagataacaggaggaagtcatttttatgtttcagatgaagctcagaacaatggcctcattgatgcttttggggctcttacatcaggaaatactgatctctcccagaagtcccttcagctcgaaagtaagggattaacactgaatagtaatgcctggatgaacgacactgtcataattgatagtacagtgggaaaggacacgttctttctcatcacatggaacagtctgcctcccagtatttctctctgggatcccagtggaacaataatggaaaatttcacagtggatgcaacttccaaaatggcctatctcagtattccaggaactgcaaaggtgggcacttgggcatacaatcttcaagccaaagcgaacccagaaacattaactattacagtaacttctcgagcagcaaattcttctgtgcctccaatcacagtgaatgctaaaatgaataaggacgtaaacagtttccccagcccaatgattgtttacgcagaaattctacaaggatatgtacctgttcttggagccaatgtgactgctttcattgaatcacagaatggacatacagaagttttggaacttttggataatggtgcaggcgctgattctttcaagaatgatggagtctactccaggtattttacagcatatacagaaaatggcagatatagcttaaaagttcgggctcatggaggagcaaacactgccaggctaaaattacggcctccactgaatagagccgcgtacataccaggctgggtagtgaacggggaaattgaagcaaacccgccaagacctgaaattgatgaggatactcagaccaccttggaggatttcagccgaacagcatccggaggtgcatttgtggtatcacaagtcccaagccttcccttgcctgaccaatacccaccaagtcaaatcacagaccttgatgccacagttcatgaggataagattattcttacatggacagcaccaggagataattttgatgttggaaaagttcaacgttatatcataagaataagtgcaagtattcttgatctaagagacagttttgatgatgctcttcaagtaaatactactgatctgtcaccaaaggaggccaactccaaggaaagctttgcatttaaaccagaaaatatctcagaagaaaatgcaacccacatatttattgccattaaaagtatagataaaagcaatttgacatcaaaagtatccaacattgcacaagtaactttgtttatccctcaagcaaatcctgatgacattgatcctacacctactcctactcctactcctactcctgataaaagtcataattctggagttaatatttctacgctggtattgtctgtgattgggtctgttgtaattgttaactttattttaagtaccaccatttgaaccttaacgaagaaaaaaatcttcaagtagacctagaagagagttttaaaaaacaaaacaatgtaagtaaaggatatttctgaatcttaaaattcatcccatgtgtgatcataaactcataaaaataattttaagatgtcggaaaaggatactttgattaaataaaaacactcatggatatgtaaaaactgtcaagattaaaatttaatagtttcatttatttgttattttatttgtaagaaatagtgatgaacaaagatcctttttcatactgatacctggttgtatattatttgatgcaacagttttctgaaatgatatttcaaattgcatcaagaaattaaaatcatctatctgagtagtcaaaatacaagtaaaggagagcaaataaacaacatttggaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 258 - protein, 919 aa, Homo Sapien
MGLFRGFVFLLVLCLLHQSNTSFIKLNNNGFEDIVIVIDPSVPEDEKIIEQIEDMVTTASTYLFEATEKRFFFKNVSILIPENWKENPQYKRPKHENHKHADVIVAPPTLPGRDEPYTKQFTECGEKGEYIHFTPDLLLGKKQNEYGPPGKLFVHEWAHLRWGVFDEYNEDQPFYRAKSKKIEATRCSAGISGRNRVYKCQGGSCLSRACRIDSTTKLYGKDCQFFPDKVQTEKASIMFMQSIDSVVEFCNEKTHNQEAPSLQNIKCNFRSTWEVISNSEDFKNTIPMVTPPPPPVFSLLKISQRIVCLVLDKSGSMGGKDRLNRMNQAAKHFLLQTVENGSWVGMVHFDSTATIVNKLIQIKSSDERNTLMAGLPTYPLGGTSICSGIKYAFQVIGELHSQLDGSEVLLLTDGEDNTASSCIDEVKQSGAIVHFIALGRAADEAVIEMSKITGGSHFYVSDEAQNNGLIDAFGALTSGNTDLSQKSLQLESKGLTLNSNAWMNDTVIIDSTVGKDTFFLITWNSLPPSISLWDPSGTIMENFTVDATSKMAYLSIPGTAKVGTWAYNLQAKANPETLTITVTSRAANSSVPPITVNAKMNKDVNSFPSPMIVYAEILQGYVPVLGANVTAFIESQNGHTEVLELLDNGAGADSFKNDGVYSRYFTAYTENGRYSLKVRAHGGANTARLKLRPPLNRAAYIPGWVVNGEIEANPPRPEIDEDTQTTLEDFSRTASGGAFVVSQVPSLPLPDQYPPSQITDLDATVHEDKIILTWTAPGDNFDVGKVQRYIIRISASILDLRDSFDDALQVNTTDLSPKEANSKESFAFKPENISEENATHIFIAIKSIDKSNLTSKVSNIAQVTLFIPQANPDDIDPTPTPTPTPTPDKSHNSGVNISTLVLSVIGSVVIVNFILSTTI

SEQ ID NO: 259 - DNA, 2243 bp, Homo Sapien
cgccggaggcagcggcggcgtggcgcagcggcgacatggccgttgtctcagaggacgactttcagcacagttcaaactccacctacggaaccacaagcagcagtctccgagctgaccaggaggcactgcttgagaagctgctggaccgcccgccccctggcctgcagaggcccgaggaccgcttctgtggcacatacatcatcttcttcagcctgggcattggcagtctactgccatggaacttctttatcactgccaaggagtactggatgttcaaactccgcaactcctccagcccagccaccggggaggaccctgagggctcagacatcctgaactactttgagagctaccttgccgttgcctccaccgtgccctccatgctgtgcctggtggccaacttcctgcttgtcaacagggttgcagtccacatccgtgtcctggcctcactgacggtcatcctggccatcttcatggtgataactgcactggtgaaggtggacacttcctcctggacccgtggtttttttgcggtcaccattgtctgcatggtgatcctcagcggtgcctccactgtcttcagcagcagcatctacggcatgaccggctcctttcctatgaggaactcccaagcactgatatcaggaggagccatgggcgggacggtcagcgccgtggcctcattggtggacttggctgcatccagtgatgtgaggaacagcgccctggccttcttcctgacggccaccatcttcctcgtgctctgcatgggactctacctgctgctgtccaggctggagtatgccaggtactacatgaggcctgttcttgcggcccatgtgttttctggtgaagaggagcttccccaggactccctcagtgccccttcggtggcctccagattcattgattcccacacaccccctctccgccccatcctgaagaagacggccagcctgggcttctgtgtcacctacgtcttcttcatcaccagcctcatctaccccgccgtctgcaccaacatcgagtccctcaacaagggctcgggctcactgtggaccaccaagtttttcatccccctcactaccttcctcctgtacaactttgctgacctatgtggccggcagctcaccgcctggatccaggtgccagggcccaacagcaaggcgctcccagggttcgtgctcctccggacctgcctcatccccctcttcgtgctctgtaactaccagccccgcgtccacctgaagactgtggtcttccagtccgatgtgtaccccgcactcctcagctccctgctggggctcagcaacggctacctcagcaccctggccctcctctacgggcctaagattgtgcccagggagctggctgaggccacgggagtggtgatgtccttttatgtgtgcttgggcttaacactgggctcagcctgctctaccctcctggtgcacctcatctagaagggaggacacaaggacattggtgcttcagagcctttgaagatgagaagagagtgcaggagggctgggggccatggaggaaaggcctaaagtttcacttggggacagagagcagagcacactcgggcctcatccctcccaagatgccagtgagccacgtccatgcccattccgtgcaaggcagatattccagtcatattaacagaacactcctgagacagttgaagaagaaatagcacaaatcaggggtactcccttcacagctgatggttaacattccaccttctttctagcccttcaaagatgctgccagtgttcgccctagagttattacaaagccagtgccaaaacccagccatgggctctttgcaacctcccagctgcgctcattccagctgacagcgagatgcaagcaaatgctcagctctccttaccctgaaggggtctccctggaatggaagtcccctggcatggtcagtcctcaggcccaagactcaagtgtgcacagacccctgtgttctgcgggtgaacaactgcccactaaccagactggaaaacccagaaagatgggccttccatgaatgcttcattccagagggaccagagggcctccctgtgcaagggatcaagcatgtctggcctgggttttcaaaaaaagagggatcctcatgacctggtggtctatggcctgggtcaagatgagggtctttcagtgttcctgtttacaacatgtcaaagccattggttcaagggcgtaataaatacttgcgtattcaaaaa

SEQ ID NO: 260 - protein, 475 aa, Homo Sapien
MAVVSEDDFQHSSNSTYGTTSSSLRADQEALLEKLLDRPPPGLQRPEDRFCGTYIIFFSLGIGSLLPWNFFITAKEYWMFKLRNSSSPATGEDPEGSDILNYFESYLAVASTVPSMLCLVANFLLVNRVAVHIRVLASLTVILAIFMVITALVKVDTSSWTRGFFAVTIVCMVILSGASTVFSSSIYGMTGSFPMRNSQALISGGAMGGTVSAVASLVDLAASSDVRNSALAFFLTATIFLVLCMGLYLLLSRLEYARYYMRPVLAAHVFSGEEELPQDSLSAPSVASRFIDSHTPPLRPILKKTASLGFCVTYVFFITSLIYPAVCTNIESLNKGSGSLWTTKFFIPLTTFLLYNFADLCGRQLTAWIQVPGPNSKALPGFVLLRTCLIPLFVLCNYQPRVHLKTVVFQSDVYPALLSSLLGLSNGYLSTLALLYGPKIVPRELAEATGVVMSFYVCLGLTLGSACSTLLVHLI

SEQ ID NO: 261 - DNA, 3038 bp, Homo Sapien
cggacgcgtgggctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtcaaaaaaaa

SEQ ID NO: 262 - protein, 307 aa, Homo Sapien
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKSSKEALSEVNATGVAMLFSAGTFLYVATVHVLPEVGGIGHSHKPDATGGRGLSRLEVAALVLGCLIPLILSVGHQH

SEQ ID NO: 263 - DNA, 3877 bp, Homo Sapien
ctccttaggtggaaaccctgggagtagagtactgacagcaaagaccgggaaagaccatacgtccccgggcaggggtgacaacaggtgtcatctttttgatctcgtgtgtggctgccttcctatttcaaggaaagacgccaaggtaattttgacccagaggagcaatgatgtagccacctcctaaccttcccttcttgaacccccagttatgccaggatttactagagagtgtcaactcaaccagcaagcggctccttcggcttaacttgtggttggaggagagaacctttgtggggctgcgttctcttagcagtgctcagaagtgacttgcctgagggtggaccagaagaaaggaaaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacaatcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcagccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaatacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaatatatatatatatatatatattgtgaaagatcaatccatctgccagaatctagtgggatggaagtttttgctacatgttatccaccccaggccaggtggaagtaactgaattattttttaaattaagcagttctactcaatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatgaa

SEQ ID NO: 264 - protein, 532 aa, Homo Sapien
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNNPAENSPNHRPYTASDFIEGIYRTERDKGTLYELTFKGDHKHEFKRLILFRPFSPIMKVKNEKLNMANTLINVIVPLAKRVDKFRQFMQNFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 265 - DNA, 3671 bp, Homo Sapien
ggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttatggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatat

SEQ ID NO: 266 - protein, 1089 aa, Homo Sapien
MQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 267 - DNA, 1701 bp, Homo Sapien
  unsure 1528: unknown base
gagactgcagagggagataaagagagagggcaaagaggcagcaagagatttgtcctggggatccagaaacccatgataccctactgaacaccgaatcccctggaagcccacagagacagagacagcaagagaagcagagataaatacactcacgccaggagctcgctcgctctctctctctctctctcactcctccctccctctctctctgcctgtcctagtcctctagtcctcaaattcccagtcccctgcaccccttcctgggacactatgttgttctccgccctcctgctggaggtgatttggatcctggctgcagatgggggtcaacactggacgtatgagggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagagctccacattgtacattatgactctgattcctatgacagcttgagtgaggctgctgagaggcctcagggcctggctgtcctgggcatcctaattgaggtgggtgagactaagaatatagcttatgaacacattctgagtcacttgcatgaagtcaggcataaagatcagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacagctggaaaagcttcaggggacattgttctccacagaagaggagccctctaagcttctggtacagaactaccgagcccttcagcctctcaatcagcgcatggtctttgcttctttcatccaagcaggatcctcgtataccacaggtgaaatgctgagtctaggtgtaggaatcttggttggctgtctctgccttctcctggctgtttatttcattgctagaaagattcggaagaagaggctggaaaaccgaaagagtgtggtcttcacctcagcacaagccacgactgaggcataaattccttctcagataccatggatgtggatgacttcccttcatgcctatcaggaagcctctaaaatggggtgtaggatctggccagaaacactgtaggagtagtaagcagatgtcctccttcccctggacatctcttagagaggaatggacccaggctgtcattccaggaagaactgcagagccttcagcctctccaaacatgtaggaggaaatgaggaaatcgctgtgttgttaatgcagagancaaactctgtttagttgcaggggaagtttgggatataccccaaagtcctctaccccctcacttttatggccctttccctagatatactgcgggatctctccttaggataaagagttgctgttgaagttgtatatttttgatcaatatatttggaaattaaagtttctgacttt

SEQ ID NO: 268 - protein, 337 aa, Homo Sapien
MLFSALLLEVIWILAADGGQHWTYEGPHGQDHWPASYPECGNNAQSPIDIQTDSVTFDPDLPALQPHGYDQPGTEPLDLHNNGHTVQLSLPSTLYLGGLPRKYVAAQLHLHWGQKGSPGGSEHQINSEATFAELHIVHYDSDSYDSLSEAAERPQGLAVLGILIEVGETKNIAYEHILSHLHEVRHKDQKTSVPPFNLRELLPKQLGQYFRYNGSLTTPPCYQSVLWTVFYRRSQISMEQLEKLQGTLFSTEEEPSKLLVQNYRALQPLNQRMVFASFIQAGSSYTTGEMLSLGVGILVGCLCLLLAVYFIARKIRKKRLENRKSVVFTSAQATTEA

SEQ ID NO: 269 - protein, 1300 aa, Homo Sapien
GTGGCGCTGGCGGTTGCTGTCAGCTGATTCCCGGGGTTGGTGGCAGCGGCGGTAGCAGCAATGGACTTTCTCCTGGGGAACCCGTTCAGCTCTCCAGTGGGACAGCGCATCGAGAAAGCCACAGATGGCTCCCTGCAGAGCGAGGACTGGGCCCTCAACATGGAGATCTGCGACATCATCAACGAGACGGAGGAAGGTCCCAAAGATGCCCTCCGAGCAGTAAAGAAGAGAATCGTGGGGAATAAGAACTTCCACGAGGTGATGCTGGCTCTCACAGTCTTAGAAACCTGTGTCAAGAACTGCGGGCACCGCTTCCACGTGCTGGTGGCCAGCCAGGACTTCGTGGAGAGTGTGCTGGTGAGGACCATCCTGCCCAAGAACAACCCACCCACCATCGTGCATGACAAAGTGCTCAACCTCATCCAGTCCTGGGCTGACGCGTTCCGCAGCTCGCCCGATCTGACAGGTGTGGTCACCATCTATGAGGACCTGCGGAGGAAAGGCCTGGAGTTCCCCATGACTGACCTGGACATGCTGTCACCCATCCACACACCCAGAGGACCGTGTTCAACTCAGAGACACAATCAGGACAGGATTCTGTGGGCACTGACTCCAGCCAGCAAGAGGACTCTGGCCAGCATGCTGCCCCTCTGCCCGCCCCGCCCATACTCTCCGGTGACACGCCCATAGCACCAACCCCGGAACAGATTGGGAAGCTGCGCAGTGAGCTGGAGATGGTGAGTGGGAACGTGAGGGTGATGTCGGAGATGCTGACGGAGCTGGTGCCCACCCAGGCCGAGCCCGCAGACCTGGAGCTGCTGCAGGAGCTCAACCGCACGTGCCGAGCCATGCAGCAGCGGGTCCTGAGTGATACCCTGCTCCGGGCCCATGCCCCAAGGAGCCCTTCAGAGCCCACACTGCCAGTCGAGGCCTGGCTGGAGGCTGGCCACAGTGGAAATTCTGCCGAGCCTATTGTCCCTACCCTGCTCTGCTGCATGGGGCCCCATGGCTTTGGCTGGCCACTGAGGGTAGGGTGTGGAGGTGTGGAGGCCCCCTGAGGAGCTGCGGCGGCCCAGGTACGAAGCTGCAACTCTGCGCGCAGTGGGCGAGATCTCATCAGCCCCAGGCTGCAGGTGAGGCTTCAGGGGATGCTGGGGCCCCACTGCCCCTCCGCTGCCTTGCCCTCCATCCTTCCTCTGTTCCTTCTGGCCGGGCACCACAGCACTGGGGCTCACCTCTTGGTTGATCCTCTTGTACTGGGAGAGGTGCCTTTTGTATCCCCAATTAAAGGTAGAAAACC

SEQ ID NO: 270 - protein, 209 aa, Homo Sapien
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPRGPCSTQRHNQDRILWALTPASKRTLASMLPLCPPRPYSPVTRP

SEQ ID NO: 271 - DNA, 1114 bp, Homo Sapien
cggacgcgtgggcggacgcgtgggcggacgcgtgggtctctgcggggagacgccagcctgcgtctgccatggggctcgggttgaggggctggggacgtcctctgctgactgtggccaccgccctgatgctgcccgtgaagccccccgcaggctcctggggggcccagatcatcgggggccacgaggtgaccccccactccaggccctacatggcatccgtgcgcttcgggggccaacatcactgcggaggcttcctgctgcgagcccgctgggtggtctcggccgcccactgcttcagccacagagacctccgcactggcctggtggtgctgggcgcccacgtcctgagtactgcggagcccacccagcaggtgtttggcatcgatgctctcaccacgcaccccgactaccaccccatgacccacgccaacgacatctgcctgctgcggctgaacggctctgctgtcctgggccctgcagtggggctgctgaggctgccagggagaagggccaggccccccacagcggggacacggtgccgggtggctggctggggcttcgtgtctgactttgaggagctgccgcctggactgatggaggccaaggtccgagtgctggacccggacgtctgcaacagctcctggaagggccacctgacacttaccatgctctgcacccgcagtggggacagccacagacggggcttctgctcggccgactccggagggcccctggtgtgcaggaaccgggctcacggcctcgtttccttctcgggcctctggtgcggcgaccccaagacccccgacgtgtacacgcaggtgtccgcctttgtggcctggatctgggacgtggttcggcggagcagtccccagcccggccccctgcctgggaccaccaggcccccaggagaagccgcctgagccacaaccttgcggcatgcaaatgagatggccgctccaggcctggaatgttccgtggctgggccccacgggaagcctgatgttcagggttggggtgggacgggcagcggtggggcacacccattccacatgcaaagggcagaagcaaacccagtaaaatgttaactgacaaaaaaaaaaaaaaaaaaaagaaa

SEQ ID NO: 272 - protein, 283 aa, Homo Sapien
MGLGLRGWGRPLLTVATALMLPVKPPAGSWGAQIIGGHEVTPHSRPYMASVRFGGQHHCGGFLLRARWVVSAAHCFSHRDLRTGLVVLGAHVLSTAEPTQQVFGIDALTTHPDYHPMTHANDICLLRLNGSAVLGPAVGLLRLPGRRARPPTAGTRCRVAGWGFVSDFEELPPGLMEAKVRVLDPDVCNSSWKGHLTLTMLCTRSGDSHRRGFCSADSGGPLVCRNRAHGLVSFSGLWCGDPKTPDVYTQVSAFVAWIWDVVRRSSPQPGPLPGTTRPPGEAA

SEQ ID NO: 273 - DNA, 2249 bp, Homo Sapien
gaagttcgcgagcgctggctatgggtcctggggcgcggctggcggcgctgctggcggtgctggcgctcgggacaggagacccagaaagggctgcggctcggggcgacacgttctcggcgctgaccagcgtggcgcgcgccctggcgcccgagcgccggctgctggggctgctgaggcggtacctgcgcggggaggaggcgcggctgcgggacctgactagattctacgacaaggtactttctttgcatgaggattcaacaacccctgtggctaaccctctgcttgcatttactctcatcaaacgcctgcagtctgactggaggaatgtggtacatagtctggaggccagtgagaacatccgagctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccgggcaggaaatgtttcgtgtgccctcagcctctctcgggagtttcttctctacagcccagataataagaggatggccaggaatgtcttgaaatatgaaaggctcttggcagagagccccaaccacgtggtagctgaggctgtcatccagaggcccaatataccccacctgcagaccagagacacctacgaggggctatgtcagaccctgggttcccagcccactctctaccagatccctagcctctactgttcctatgagaccaattccaacgcctacctgctgctccagcccatccggaaggaggtcatccacctggagccctacattgctctctaccatgacttcgtcagtgactcagaggctcagaaaattagagaacttgcagaaccatggctacagaggtcagtggtggcatcaggggagaagcagttacaagtggagtaccgcatcagcaaaagtgcctggctgaaggacactgttgacccaaaactggtgaccctcaaccaccgcattgctgccctcacaggccttgatgtccggcctccctatgcagagtatctgcaggtggtgaactatggcatcggaggacactatgagcctcactttgaccatgctacgtcaccaagcagccccctctacagaatgaagtcaggaaaccgagttgcaacatttatgatctatctgagctcggtggaagctggaggagccacagccttcatctatgccaacctcagcgtgcctgtggttaggaatgcagcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctggggtaggagaggagaaagcagagcagcctcctggaagaaggccttgtcagctttgtctgtgcctcgcaaatcagaggcaagggagaggttgttaccaggggacactgagaatgtacatttgatctgccccagccacggaagtcagagtaggatgcacagtacaaaggaggggggagtggaggcctgagagggaagtttctggagttcagatactctctgttgggaacaggacatctcaacagtctcaggttcgatcagtgggtcttttggcactttgaaccttgaccacagggaccaagaagtggcaatgaggacacctgcaggaggggctagcctgactcccagaactttaagactttctccccactgccttctgctgcagcccaagcagggagtgtccccctcccagaagcatatcccagatgagtggtacattatataaggattttttttaagttgaaaacaactttcttttctttttgtatgatggttttttaacacagtcattaaaaatgtttataaatcaaaa

SEQ ID NO: 274 - protein, 544 aa, Homo Sapien
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYSPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWLQRSVVASGEKQLQVEYRISKSAWLKDTVDPKLVTLNHRIAALTGLDVRPPYAEYLQVVNYGIGGHYEPHFDHATSPSSPLYRMKSGNRVATFMIYLSSVEAGGATAFIYANLSVPVVRNAALFWWNLHRSGEGDSDTLHAGCPVLVGDKWVANKWIHEYGQEFRRPCSSSPED

SEQ ID NO: 275 - DNA, 1915 bp, Homo Sapien
ggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagagacaaggatggagatctgaagactcaaattgaaaagctctggacagaagtcaatgccttgaaggaaattcaagccctgcagacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctaaataggtctttctccaatgtgtcctccaagcaagattcatcataacttataggttcatgatctctaagatcaagtaaaaatcataatttttacttattaaaaaattgcaacacaagatcaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttggaagtttagcgtatgtttgactaacaaaaattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattttttttttttcttcatgcctaccctttttttggaagtttccagccgcaatttgaaatgaaatgacaaggtgtatatttgatcaattttcattcccaccattgcattacaacctctaacttaaatgggtaaccctaaggcatatcaaagaagcagattgcatgataaacggaaatagaaaaaaagaacctacatttattttgctttagcatccttactctcaccttttatgagattgagagtggacttacatttccttttttacattttcgtatatttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtgttttgtgaacaatatcccactttgcaaactttaactacacatgcttggaattaagttttagctgttttcattgctcaataataaagcctgaattctgatcaataaaaaaaaaaaaaaaaaaaaaaaaaaaaa

SEQ ID NO: 276 - protein, 206 aa, Homo Sapien [sequence omitted]

SEQ ID NO: 277 - DNA, 1778 bp, Homo Sapien
gagatagggagtctgggtttaagttcctgctccatctcaggagcccctgctcccacccctaggaagccaccagactccacggtgtggggccaatcaggtggaatcggccctggcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgtgcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttttacgtgatttttgtaacattcatttttttgtacagataacaggagtttctgactaatcaaagctggtatttccccgcatgtcttattcttgcccttcccccaaccagtttgttaatcaaacaataaaaacatgttttgttttgtttttaaaaaaaaa

SEQ ID NO: 278 - protein, 294 aa, Homo Sapien [sequence omitted]

SEQ ID NO: 279 - DNA, 1636 bp, Homo Sapien
gaggagcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgtataagctctccttcctggtgaacgccttagctaagcaggtcatgaacctcctagtgccatccctgcccaatctagtgaaaaaccagctgtgtcccgtgatcgaggcttccttcaatggcatgtatgcagacctcctgcagctggtgaaggtgcccatttccctcagcattgaccgtctggagtttgaccttctgtatcctgccatcaagggtgacaccattcagctctacctgggggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggatgcccttgtgcttactccagcctccttgtggaaacccagctctcctgtctcccagtgaagacttggatggcagccatcagggaaggctgggtcccagctgggagtatgggtgtgagctctatagaccatccctctctgcaatcaataaacacttgcctgtgaaaaa

SEQ ID NO: 280 - protein, 484 aa, Homo Sapien [sequence omitted]

SEQ ID NO: 281 - DNA, 1732 bp, Homo Sapien
cccacgcgtccgcgcctctcccttctgctggaccttccttcgtctctccatctctccctcctttccccgcgttctctttccacctttctcttcttcccaccttagacctcccttcctgccctcctttcctgcccaccgctgcttcctggcccttctccgaccccgctctagcagcagacctcctggggtctgtgggttgatctgtggcccctgtgcctccgtgtccttttcgtctcccttcctcccgactccgctcccggaccagcggcctgaccctggggaaaggatggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccactgccagactcctgctgccaagcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaagatgaggaaactgaggctcagagaggtgaagtacctggcccaaggccacacagccagaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctcaaaaaaaaaaaaaaaaaaaaaa

SEQ ID NO: 282 - protein, 451 aa, Homo Sapien
MVPEVRVLSSLLGLALLWFPLDSHARARPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKDEETEAQRGEVPGPRPHSQNLPLDSDQESQEARLPERGTALPTARWPPRRSLERLPSPDPGAEGHGQSRQSDQDITKT

SEQ ID NO: 283 - DNA, 2294 bp, Homo Sapien
gcgatggtgcgcccggtggcggtggcggcggcggttgcggaggcttccttggtcggattgcaacgaggagaagatgactgaccaaccgactggctgaatgaatgaatggcggagccgagcgcgccatgaggagcctgccgagcctgggcggcctcgccctgttgtgctgcgccgccgccgccgccgccgtcgcctcagccgcctcggcggggaatgtcaccggtggcggcggggccgcggggcaggtggacgcgtcgccgggccccgggttgcggggcgagcccagccaccccttccctagggcgacggctcccacggcccaggccccgaggaccgggcccccgcgcgccaccgtccaccgacccctggctgcgacttctccagcccagtccccggagaccacccctctttgggcgactgctggaccctcttccaccacctttcaggcgccgctcggcccctcgccgaccacccctccggcggcggaacgcacttcgaccacctctcaggcgccgaccagacccgcgccgaccaccctttcgacgaccactggcccggcgccgaccacccctgtagcgaccaccgtaccggcgcccacgactccccggaccccgacccccgatctccccagcagcagcaacagcagcgtcctccccaccccacctgccaccgaggccccctcttcgcctcctccagagtatgtatgtaactgctctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacaggtaagcaacagagggtggaactgaagtttattttattttagcaagggaaaaaaaaaggctgctactctcaaggaccatactggtttaaacaaaggaggatgagggtcatagatttacaaaatattttatatacttttattctcttactttatatgttatatttaatgtcaggatttaaaaacatctaatttactgatttagttcttcaaaagcactagagtcgccaatttttctctgggataatttctgtaaatttcatgggaaaaaattattgaagaataaatctgctttctggaagggctttcaggcatgaaacctgctaggaggtttagaaatgttcttatgtttattaatataccattggagtttgaggaaatttgttgtttggtttatttttctctctaatcaaaattctacatttgtttctttggacatctaaagcttaacctgggggtaccctaatttatttaactagtggtaagtagactggttttactctatttaccagtacatttttgagaccaaaagtagattaagcaggaattatctttaaactattatgttatttggaggtaatttaatctagtggaataatgtactgttatctaagcatttgccttgtactgcactgaaagtaattattctttgaccttatgtgaggcacttggctttttgtggaccccaagtcaaaaaactgaagagacagtattaaataatgaaaaaaataatgacaggttatactcagtgtaacctgggtataacccaagatctgctgccacttacgagctgtgttccttgggcaagtaatttcctttcactgagcttgtttcttctcaaggttgttgtgaagattaaatgagttgatatatataaaatgcctagcacatgtcactcaataaattctggtttgttttaatttcaaaggaatattatggactgaaatgagagaacatgttttaagaacttttagctccttgacaaagaagtgctttatactttagcactaaatattttaaatgctttataaatgatattatactgttatggaatattgtatcatattgtagtttattaaaaatgtagaagaggctgggcgcggtggctcacgcctgtaatcctagcactttgggaggccaaggcgggtggatcacttgaggccaggagttctagatgagcctggccagcacagtgaaaccccgtctctactaaaaatacaaacaaattagctgggcgtggtggcacacacctgtagtcccagctactcgggaggctgaggcaggagaatcggttgaacccgggaggtggaggttgcagtgagctgagatcgcgccactgcactccagcctggtgagagagggagactctgtcttaaaaaaaaaaaaaaaaaaaaaaaaaa

SEQ ID NO: 284 - protein, 258 aa, Homo Sapien
MRSLPSLGGLALLCCAAAAAAVASAASAGNVTGGGGAAGQVDASPGPGLRGEPSHPFPRATAPTAQAPRTGPPRATVHRPLAATSPAQSPETTPLWATAGPSSTTFQAPLGPSPTTPPAAERTSTTSQAPTRPAPTTLSTTTGPAPTTPVATTVPAPTTPRTPTPDLPSSSNSSVLPTPPATEAPSSPPPEYVCNCSVVGSLNVNRCNQTTGQCECRPGYQGLHCETCKEGFYLNYTSGLCQPCDCSPHGALSIPCNR

SEQ ID NO: 285 - DNA, 1665 bp, Homo Sapien
aacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctacccgcctcagaacttgaccatgactgtcttccaaggagacggcacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagcaaagccacatcaggagtgactcagggggtggtcgggggagctggagccacagccctggtcttcctgtccttctgcgtcatcttcgttgtagtgaggtcctgcaggaagaaatcggcaaggccagcagcgggcgtgggagatacgggcatagaggatgcaaacgctgtcaggggttcagcctctcaggggcccctgactgaaccttgggcagaagacagtcccccagaccagcctcccccagcttctgcccgctcctcagtgggggaaggagagctccagtatgcatccctcagcttccagatggtgaagccttgggactcgcggggacaggaggccactgacaccgagtactcggagatcaagatccacagatgagaaactgcagagactcaccctgattgagggatcacagcccctccaggcaagggagaagtcagaggctgattcttgtagaattaacagccctcaacgtgatgagctatgataacactatgaattatgtgcagagtgaaaagcacacaggctttagagtcaaagtatctcaaacctgaatccacactgtgccctcccttttatttttttaactaaaagacagacaaattccta

SEQ ID NO: 286 - protein, 463 aa, Homo Sapien
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHR

SEQ ID NO: 287 - DNA, 2210 bp, Homo Sapien
cgcgagctgagaggagcaggtagaggggcagaggcgggactgtcgtctgggggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacacctgtcctcctttgacccctgcttctaccgagacctgctgctggtgcaccgcttcctaccttatgagatgctgctcatgtgggatgcgctgaaccagcccaacctcacctgcggcaatcagacacagatctactgagtcagcatcagggtccccagcctctgggctcctgtttccataggaaggggcgacaccttcctcccaggaagctgagacctttgtggtctgagcataagggagtgccagggaaggtttgaggtttgatgagtgaatattctggctggcgaactcctacacatccttcaaaacccacctggtactgttccagcatcttccctggatggctggaggaactccagaaaatatccatcttctttttgtggctgctaatggcagaagtgcctgtgctagagttccaactgtggatgcatccgtcccgtttgagtcaaagtcttacttccctgctctcacctactcacagacgggatgctaagcagtgcacctgcagtggtttaatggcagataagctccgtctgcagttccaggccagccagaaactcctgtgtccacatagagctgacgtgagaaatatctttcagcccaggagagaggggtcctgatcttaaccctttcctgggtctcagacaactcagaaggttggggggataccagagaggtggtggaataggaccgccccctccttacttgtgggatcaaatgctgtaatggtggaggtgtgggcagaggagggaggcaagtgtctttgaaagttgtgagagctcagagtttctggggtcctcattaggagcccccatccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccctgcagcccccagcttcaggcctcagtgtctgccagtcaagcttcacaggcattgtgatggggcagccttggggaatataaaattttgtgaagaaaaaaaaaaaaaaaaaaaaaaaaaaaaaaaaaaaaa

SEQ ID NO: 288 - protein, 372 aa, Homo Sapien
MKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVLFLQWQETRCANASFVLNGDDDVFAHTDNMVFYLQDHDPGRHLFVGQLIQNVGPIRAFWSKYYVPEVVTQNERYPPYCGGGGFLLSRFTAAALRRAAHVLDIFPIDDVFLGMCLELEGLKPASHSGIRTSGVRAPSQHLSSFDPCFYRDLLLVHRFLPYEMLLMWDALNQPNLTCGNQTQIY

SEQ ID NO: 289 - DNA, 4842 bp, Homo Sapien
cgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctctactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgccaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcagctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctccgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgaccaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttaaaaaaaaaaaaaaaaaaaaaaaa

SEQ ID NO: 290 - protein, 1523 aa, Homo Sapien [sequence omitted]

SEQ ID NO: 291 - DNA, 753 bp, Homo Sapien
ggatgcaggacgctcccctgagctgcctgtcaccgactaggtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagccccgacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacacaaggaatgaactattggcaaggctggaagaaacattgtgagggcagagacctgtccgagtggaaaaaaggctgtgaggtttcctaaactggaactggacccaggatgctttgcagcaacgccctaggatttgcagtgaatgtccaaatgcctgtgtcatcttgtcccgtttcctcccaatattccttctcaaacttggagagggaaaattaagctatacttttaagaaaataaatatttccatttaaatgtc

SEQ ID NO: 292 - protein, 148 aa, Homo Sapien
MKAAGILTLIGCLVTGAESKIYTRCKLAKIFSRAGLDNYWGFSLGNWICMAYYESGYNTTAPTVLDDGSIDYGIFQINSFAWCRRGKLKENNHCHVACSALITDDLTDAIICARKIVKETQGMNYWQGWKKHCEGRDLSEWKKGCEVS

SEQ ID NO: 293 - DNA, 1176 bp, Homo Sapien
agaaagctgcactctgttgagctccagggcgcagtggagggagggagtgaaggagctctctgtacccaaggaaagtgcagctgagactcagacaagattacaatgaaccaactcagcttcctgctgtttctcatagcgaccaccagaggatggagtacagatgaggctaatacttacttcaaggaatggacctgttcttcgtctccatctctgcccagaagctgcaaggaaatcaaagacgaatgtcctagtgcatttgatggcctgtattttctccgcactgagaatggtgttatctaccagaccttctgtgacatgacctctgggggtggcggctggaccctggtggccagcgtgcatgagaatgacatgcgtgggaagtgcacggtgggcgatcgctggtccagtcagcagggcagcaaagcagactacccagagggggacggcaactgggccaactacaacacctttggatctgcagaggcggccacgagcgatgactacaagaaccctggctactacgacatccaggccaaggacctgggcatctggcacgtgcccaataagtcccccatgcagcactggagaaacagctccctgctgaggtaccgcacggacactggcttcctccagacactgggacataatctgtttggcatctaccagaaatatccagtgaaatatggagaaggaaagtgttggactgacaacggcccggtgatccctgtggtctatgattttggcgacgcccagaaaacagcatcttattactcaccctatggccagcgggaattcactgcgggatttgttcagttcagggtatttaataacgagagagcagccaacgccttgtgtgctggaatgagggtcaccggatgtaacactgagcatcactgcattggtggaggaggatactttccagaggccagtccccagcagtgtggagatttttctggttttgattggagtggatatggaactcatgttggttacagcagcagccgtgagataactgaggcagctgtgcttctattctatcgttgagagttttgtgggagggaacccagacctctcctcccaaccatgagatcccaaggatggagaacaacttacccagtagctagaatgttaatggcagaagagaaaacaataaatcatattgactcaagaaaaaaa

SEQ ID NO: 294 - protein, 313 aa, Homo Sapien
MNQLSFLLFLIATTRGWSTDEANTYFKEWTCSSSPSLPRSCKEIKDECPSAFDGLYFLRTENGVIYQTFCDMTSGGGGWTLVASVHENDMRGKCTVGDRWSSQQGSKADYPEGDGNWANYNTFGSAEAATSDDYKNPGYYDIQAKDLGIWHVPNKSPMQHWRNSSLLRYRTDTGFLQTLGHNLFGIYQKYPVKYGEGKCWTDNGPVIPVVYDFGDAQKTASYYSPYGQREFTAGFVQFRVFNNERAANALCAGMRVTGCNTEHHCIGGGGYFPEASPQQCGDFSGFDWSGYGTHVGYSSSREITEAAVLLFYR

SEQ ID NO: 295 - DNA, 1648 bp, Homo Sapien
caggccatttgcatcccactgtccttgtgttcggagccaggccacaccgtcctcagcagtgtcatgtgttaaaaacgccaagctgaatatatcatgcccctattaaaacttgtacatggctccccattggtttttggagaaaagttcaagctttttaccttggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcataaaaaaaaaaaaaaaaaaa

SEQ ID NO: 296 - protein, 323 aa, Homo Sapien
MPLLKLVHGSPLVFGEKFKLFTLVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 297 - DNA, 1554 bp, Homo Sapien
gactacgccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacatcggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagcttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaa

SEQ ID NO: 298 - protein, 462 aa, Homo Sapien
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTVWSEIGKGFLDGSLDKNMTRKKQYEDALMQLESVLRNIIKERKGRNFSQHIFIDSLVQGNLNDQQILEDSMIFSLASCIITAKLCTWAICFLTTSEEVQKKLYEEINQVFGNGPVTPEKIEQLRYCQHVLCETVRTAKLTPVSAQLQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 299 - DNA, 759 bp, Homo Sapien
ctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcagctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattggtacatttttgtcttctgcagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattaaaaaaaaaaaa

SEQ ID NO: 300 - protein, 140 aa, Homo Sapien
MGRVSGLVPSRFLTLLAHLVVVITLFWSRDSNIQACLPLTFTPEEYDKQDIQLVAALSVTLGLFAVELAGFLSGVSMFNSTQSLISIGAHCSASVALSFFIFERWECTTYWYIFVFCSALPAVTEMALFVTVFGLKKKPF

SEQ ID NO: 301 - DNA, 1871 bp, Homo Sapien
ctgggaccccgaaaagagaaggggagagcgaggggacgagagcggaggaggaagatgcaactgactcgctgctgcttcgtgttcctggtgcagggtagcctctatctggtcatctgtggccaggatgatggtcctcccggctcagaggaccctgagcgtgatgaccacgagggccagccccggccccgggtgcctcggaagcggggccacatctcacctaagtcccgccccatggccaattccactctcctagggctgctggccccgcctggggaggcttggggcattcttgggcagccccccaaccgcccgaaccacagccccccaccctcagccaaggtgaagaaaatctttggctggggcgacttctactccaacatcaagacggtggccctgaacctgctcgtcacagggaagattgtggaccatggcaatgggaccttcagcgtccacttccaacacaatgccacaggccagggaaacatctccatcagcctcgtgccccccagtaaagctgtagagttccaccaggaacagcagatcttcatcgaagccaaggcctccaaaatcttcaactgccggatggagtgggagaaggtagaacggggccgccggacctcgctttgcacccacgacccagccaagatctgctcccgagaccacgctcagagctcagccacctggagctgctcccagcccttcaaagtcgtctgtgtctacatcgccttctacagcacggactatcggctggtccagaaggtgtgcccagattacaactaccatagtgataccccctactacccatctgggtgacccggggcaggccacagaggccaggccagggctggaaggacaggcctgcccatgcaggagaccatctggacaccgggcagggaaggggttgggcctcaggcagggaggggggtggagacgaggagatgccaagtggggccagggccaagtctcaagtggcagagaaagggtcccaagtgctggtcccaacctgaagctgtggagtgactagatcacaggagcactggaggaggagtgggctctctgtgcagcctcacagggctttgccacggagccacagagagatgctgggtccccgaggcctgtgggcaggccgatcagtgtggccccagatcaagtcatgggaggaagctaagcccttggttcttgccatcctgaggaaagatagcaacagggagggggagatttcatcagtgtggacagcctgtcaacttaggatggatggctgagagggcttcctaggagccagtcagcagggtggggtggggccagaggagctctccagccctgcctagtgggcgccctgagccccttgtcgtgtgctgagcatggcatgaggctgaagtggcaaccctggggtctttgatgtcttgacagattgaccatctgtctccagccaggccacccctttccaaaattccctcttctgccagtactccccctgtaccacccattgctgatggcacacccatccttaagctaagacaggacgattgtggtcctcccacactaaggccacagcccatccgcgtgctgtgtgtccctcttccaccccaacccctgctggctcctctgggagcatccatgtcccggagaggggtccctcaacagtcagcctcacctgtcagaccggggttctcccggatctggatggcgccgccctctcagcagcgggcacgggtggggcggggccgggccgcagagcatgtgctggatctgttctgtgtgtctgtctgtgggtggggggaggggagggaagtcttgtgaaaccgctgattgctgacttttgtgtgaagaatcgtgttcttggagcaggaaataaagcttgccccggggca

SEQ ID NO: 302 - protein, 252 aa, Homo Sapien
MQLTRCCFVFLVQGSLYLVICGQDDGPPGSEDPERDDHEGQPRPRVPRKRGHISPKSRPMANSTLLGLLAPPGEAWGILGQPPNRPNHSPPPSAKVKKIFGWGDFYSNIKTVALNLLVTGKIVDHGNGTFSVHFQHNATGQGNISISLVPPSKAVEFHQEQQIFIEAKASKIFNCRMEWEKVERGRRTSLCTHDPAKICSRDHAQSSATWSCSQPFKVVCVYIAFYSTDYRLVQKVCPDYNYHSDTPYYPSG

SEQ ID NO: 303 - DNA, 902 bp, Homo Sapien
cggtggccatgactgcggccgtgttcttcggctgcgccttcattgccttcgggcctgcgctcgccctttatgtcttcaccatcgccatcgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagata

SEQ ID NO: 304 - protein, 257 aa, Homo Sapien [sequence omitted]

SEQ ID NO: 305 - DNA, 1073 bp, Homo Sapien
aatttttcaccagagtaaacttgagaaaccaactggaccttgagtattgtacattttgcctcgtggacccaaaggtagcaatctgaaacatgaggagtacgattctactgttttgtcttctaggatcaactcggtcattaccacagctcaaacctgctttgggactccctcccacaaaactggctccggatcagggaacactaccaaaccaacagcagtcaaatcaggtctttccttctttaagtctgataccattaacacagatgctcacactggggccagatctgcatctgttaaatcctgctgcaggaatgacacctggtacccagacccacccattgaccctgggagggttgaatgtacaacagcaactgcacccacatgtgttaccaatttttgtcacacaacttggagcccagggcactatcctaagctcagaggaattgccacaaatcttcacgagcctcatcatccattccttgttcccgggaggcatcctgcccaccagtcaggcaggggctaatccagatgtccaggatggaagccttccagcaggaggagcaggtgtaaatcctgccacccagggaaccccagcaggccgcctcccaactcccagtggcacagatgacgactttgcagtgaccacccctgcaggcatccaaaggagcacacatgccatcgaggaagccaccacagaatcagcaaatggaattcagtaagctgtttcaaattttttcaactaagctgcctcgaatttggtgatacatgtgaatctttatcattgattatattatggaatagattgagacacattggatagtcttagaagaaattaattcttaatttacctgaaaatattcttgaaatttcagaaaatatgttctatgtagagaatcccaacttttaaaaacaataattcaatggataaatctgtctttgaaatataacattatgctgcctggatgatatgcatattaaaacatatttggaaaactggaaaaaaaaaaaaaaaaaaaaaaaaaaaaaaaaaaaaaaaaaaaaaaaaaaaaaaaaaaaaaaaaaaaaaaaaaaaa

SEQ ID NO: 306 - protein, 209 aa, Homo Sapien
MRSTILLFCLLGSTRSLPQLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGGILPTSQAGANPDVQDGSLPAGGAGVNPATQGTPAGRLPTPSGTDDDFAVTTPAGIQRSTHAIEEATTESANGIQ

SEQ ID NO: 307 - DNA, 2786 bp, Homo Sapien
ccggggacatgaggtggatactgttcattggggcccttattgggtccagcatctgtggccaagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcgtatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcggtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcatccacatctagccaagccagtgaccttgctctggtggcactgtgggagacaccacttgtctttaggtgggtctcaaagatgatgtagaatttcctttaatttctcgcagtcttcctggaaaatattttcctttgagcagcaaatcttgtagggatatcagtgaaggtctctccctccctcctctcctgttttttttttttttgagacagagttttgctcttgttgcccaggctggagtgtgatggctcgatcttggctcaccacaacctctgcctcctgggttcaagcaattctcctgcctcagcctcttgagtagcttggtttataggcgcatgccaccatgcctggctaattttgtgtttttagtagagacagggtttctccatgttggtcaggctggtctcaaactcccaacctcaggtgatctgccctccttggcctcccagagtgctgggattacaggtgtgagccactgtgccgggcccgtcccctccttttttaggcctgaatacaaagtagaagatcactttccttcactgtgctgagaatttctagatactacagttcttactcctctcttccctttgttattcagtgtgaccaggatggcgggaggggatctgtgtcactgtaggtactgtgcccaggaaggctgggtgaagtgaccatctaaattgcaggatggtgaaattatccccatctgtcctaatgggcttacctcctctttgccttttgaactcacttcaaagatctaggcctcatcttacaggtcctaaatcactcatctggcctggataatctcactgccctggcacattcccatttgtgctgtggtgtatcctgtgtttccttgtcctggtttgtgtgtgtgtgtgtgtgtgtgtgtgtgtgtgtgtttgtgtgtgtgtgtctgtctattttgtatcctggaccacaagttcctaagtagagcaagaattcatcaaccagctgcctcttgtttcatttcacctcagcacgtaccatctgtccttttgttgttgttgttttgtttttgtttttttgcttttaccaaacatgtctgtaaatcttaacctcctgcctaggatttgtacagcatctggtgtgtgcttataagccaataaatattcaatgtgaaaaaaaaaaaaaaaaa

SEQ ID NO: 308 - protein, 421 aa, Homo Sapien
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQALLDNEDDEMQHNEGQERSSNNFNYGAYHSLEAIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 309 - DNA, 2436 bp, Homo Sapien
ggctgaccgtgctacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagtcaccaactctgggtccagtgtgacctccagtggagccagcactgccaccaactctgagtccagcacagtgtccagtagggccagcactgccaccaactctgagtctagcacactctccagtggggccagcacagccaccaactctgactccagcacaacctccagtggggctagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgactccagcacagtgtccagtggggccagcactgccaccaactctgagtccagcacgacctccagtggggccagcacagccaccaactctgagtccagcacgacctccagtggggctagcacagccaccaactctgactccagcacaacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgagtccagcacagtgtccagtggggccagcactgccaccaactctgagtccagcacaacctccagtggggtcagcacagccaccaactctgagtccagcacaacctccagtggggctagcacagccaccaactctgactccagcacaacctccagtgaggccagcacagccaccaactctgagtctagcacagtgtccagtgggatcagcacagtcaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcaaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcatcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcttgccccggggtgggtatctagctctgagatgaactcagttataggagaaaacctccatgctggactccatctggcattcaaaatctccacagtaaaatccaaagacctcaaaaaaaaaaaaaaaaaaaaaaaaaaaaaaaaaaaaaaaaaaaaaaaaaaaaaa

SEQ ID NO: 310 - protein, 596 aa, Homo Sapien
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTVTNSGSSVTSSGASTATNSESSTVSSRASTATNSESSTLSSGASTATNSDSSTTSSGASTATNSESSTTSSGASTATNSESSTVSSRASTATNSESSTTSSGASTATNSESRTTSNGAGTATNSESSTTSSGASTATNSDSSTVSSGASTATNSESSTTSSGASTATNSESSTTSSGASTATNSDSSTTSSGAGTATNSESSTVSSGISTVTNSESSTPSSGANTATNSESSTTSSGANTATNSESSTVSSGASTATNSESSTTSSGVSTATNSESSTTSSGASTATNSDSSTTSSEASTATNSESSTVSSGISTVTNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 311 - DNA, 4563 bp, Homo Sapien
  unsure 3635: unknown base
ctaagccggaggatgtgcagctgcggcggcggcgccggctacgaagaggacggggacaggcgccgtgcgaaccgagcccagccagccggaggacgcgggcagggcgggacgggagcccggactcgtctgccgccgccgtcgtcgccgtcgtgccggccccgcgtccccgcgcgcgagcgggaggagccgccgccacctcgcgcccgagccgccgctagcgcgcgccgggcatggtcccctcttaaaggcgcaggccgcggcggcgggggcgggtgtgcggaacaaagcgccggcgcggggcctgcgggcggctcgggggccgcgatgggcgcggcgggcccgcggcggcggcggcgctgcccgggccgggcctcgcggcgctagggcgggctggcctccgtgggcgggggcagcgggctgagggcgcgcggagcctgcggcggcggcggcggcggcggcggcggcccggcgggcggagcggcgcgggcatggccgcgcgcggccggcgcgcctggctcagcgtgctgctcgggctcgtcctgggcttcgtgctggcctcgcggctcgtcctgccccgggcttccgagctgaagcgagcgggcccacggcgccgcgccagccccgagggctgccggtccgggcaggcggcggcttcccaggccggcggggcgcgcggcgatgcgcgcggggcgcagctctggccgcccggctcggacccagatggcggcccgcgcgacaggaactttctcttcgtgggagtcatgaccgcccagaaatacctgcagactcgggccgtggccgcctacagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcggcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtgtttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacccagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgttttttttttttacaattgttttaaagccatttcatgttccagttgtaagataaggaaatgtgataatagctgtttcatcattgtcttcaggagagctttccagagttgatcatttcctctcatggtactctgctcagcatggccacgtaggttttttgtttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagntagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacatacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgtacttttcgaaccattttgtctcattattcctgttttagctgaagaattgtattacatttggagagtaaaaaacttaaacacgaaaaaa

SEQ ID NO: 312 - protein, 802 aa, Homo Sapien [sequence omitted]

SEQ ID NO: 313 - DNA, 1728 bp, Homo Sapien
ggccggacgcctccgcgttacgggatgaattaacggcgggttccgcacggaggttgtgacccctacggagccccagcttgcccacgcaccccactcggcgtcgcgcggcgtgccctgcttgtcacaggtgggaggctggaactatcaggctgaaaaacagagtgggtactctcttctgggaagctggcaacaaatggatgatgtgatatatgcattccaggggaagggaaattgtggtgcttctgaacccatggtcaattaacgaggcagtttctagctactgcacgtacttcataaagcaggactctaaaagctttggaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatggaaggatgacaagagccatttcgaagacatgattgattacttttgtgatattcacgaaccacttcaactcctcatattcccagaagggactgatctcacagaaaacagcaagtctcgaagtaatgcatttgctgaaaaaaatggacttcagaaatatgaatatgttttacatccaagaactacaggctttacttttgtggtagaccgtctaagagaaggtaagaaccttgatgctgtccatgatatcactgtggcgtatcctcacaacattcctcaatcagagaagcacctcctccaaggagactttcccagggaaatccactttcacgtccaccggtatccaatagacaccctccccacatccaaggaggaccttcaactctggtgccacaaacggtgggaagagaaagaagagaggctgcgttccttctatcaaggggagaagaatttttattttaccggacagagtgtcattccaccttgcaagtctgaactcagggtccttgtggtcaaattgctctctatactgtattggaccctgttcagccctgcaatgtgcctactcatatatttgtacagtcttgttaagtggtattttataatcaccattgtaatctttgtgctgcaagagagaatatttggtggactggagatcatagaacttgcatgttaccgacttttacacaaacagccacatttaaattcaaagaaaaatgagtaagattataaggtttgccatgtgaaaacctagagcatattttggaaatgttctaaacctttctaagctcagatgcatttttgcatgactatgtcgaatatttcttactgccatcattatttgttaaagatattttgcacttaattttgtgggaaaaatattgctacaattttttttaatctctgaatgtaatttcgatactgtgtacatagcagggagtgatcggggtgaaataacttgggccagaatattattaaacaatcatcaggcttttaaa

SEQ ID NO: 314 - protein, 414 aa, Homo Sapien [sequence omitted]

SEQ ID NO: 315 - DNA, 2403 bp, Homo Sapien
cggctcgagcggctcgagtgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggagagacgtttttccagccctcaccttggcgcctggcttctattttactcgggttactctgtggtgccctgtgtggtgttgtcatggggatgataattgttttcttcaaatccaaagggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggagacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaagaaaaccataaaaaaaaaaaaaaa

SEQ ID NO: 316 - protein, 466 aa, Homo Sapien [sequence omitted]

SEQ ID NO: 317 - DNA, 681 bp, Homo Sapien
gcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaaggtaagtagaatcatcctaatcatattacatcaatgaaaatctaatatggcgataaaaatcattgtctacattaaaacttcttatagttcataaaattatttcaaatccatcatctctttaaatcctgcctcctcttcatgaggtacttaggatagccattatttcagtttcacataagaatgtttactcaatgtttaagtgttttgccccaaaattcacaactaacaaggcagaactaggacttgaacatggatcttttggttcttaatccagtgagtgatacaattcaatgcactcccctgcca

SEQ ID NO: 318 - protein, 128 aa, Homo Sapien
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKVSRIILIILHQ

SEQ ID NO: 319 - DNA, 2103 bp, Homo Sapien
ccttcacaggactcttcattgctggttggcaatgatgtatcggccagatgtggtgagggctaggaaaagagtttgttgggaaccctgggttatcggcctcgtcatcttcatatccctgattgtcctggcagtgtgcattggactcactgttcattatgtgagatataatcaaaagaagacctacaattactatagcacattgtcatttacaactgacaaactatatgctgagtttggcagagaggcttctaacaattttacagaaatgagccagagacttgaatcaatggtgaaaaatgcattttataaatctccattaagggaagaatttgtcaagtctcaggttatcaagttcagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcactcagttaaaattaaaaaaatcaacaagacagaaacagacagctatctaaaccattgctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagacaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacgtaagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaagtccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcaccca

SEQ ID NO: 320 - protein, 423 aa, Homo Sapien
MMYRPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFSQQKHGVLAHMLLICRFHSTEDPETVDKIVQLVLHEKLQDAVGPPKVDPHSVKIKKINKTETDSYLNHCCGTRRSKTLGQSLRIVGGTEVEEGEWPWQASLQWDGSHRCGATLINATWLVSAAHCFTTYKNPARWTASFGVTIKPSKMKRGLRRIIVHEKYKHPSHDYDISLAELSSPVPYTNAVHRVCLPDASYEFQPGDVMFVTGFGALKNDGYSQNHLRQAQVTLIDATTCNEPQAYNDAITPRMLCAGSLEGKTDACQGDSGGPLVSSDARDIWYLAGIVSWGDECAKPNKPGVYTRVTALRDWITSKTGI

SEQ ID NO: 321 - DNA, 1034 bp, Homo Sapien
ccgggctcctgggtgaggccggcaagtttggagcgtggtcagacaataggggcgtggctacggctcgcggagcgcaaccaacgctctagaccagacctgggctcgagaccataactgtttggctttaacagtacgtgggcggccggaatccgggagtccggtgacccgggctgtggtctagcataaaggcggagcccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaaaaa

SEQ ID NO: 322 - protein, 242 aa, Homo Sapien
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 323 - DNA, 2397 bp, Homo Sapien
agagaaagaagcgtctccagctgaagccaatgcagccctccggctctccgcgaagaagttccctgccccgatgagcccccgccgtgcgtccccgactatccccaggcgggcgtggggcaccgggcccagcgccgacgatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatggttccagtacaatggtcagatatggtcactttgaaagccaggatgacaaattatggattacctagatatcggtggcttactcatgcttggaatttttttcagagagagtttaagtgctgtggagtagtatatttcactgactggttggaaatgacagagatggactggcccccagattcctgctgtgttagagaattcccaggatgttccaaacaggcccaccaggaagatctcagtgacctttatcaagagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagcctgggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataaaaagaaatgtcacagaagaaaaccacaaacttgttttattggacttgtgaatttttgagtacatactatgtgtttcagaaatatgtagaaataaaaatgttgccataaaataacacctaagcatatactattctatgctttaaaatgaggatggaaaagtttcatgtcataagtcaccacctggacaataattgatgcccttaaaatgctgaagacagatgtcatacccactgtgtagcctgtgtatgacttttactgaacacagttatgttttgaggcagcatggtttgattagcatttccgcatccatgcaaacgagtcacatatggtgggactggagccatagtaaaggttgatttacttctaccaactagtatataaagtactaattaaatgctaacataggaagttagaaaatactaataacttttattactcagcgatctattcttctgatgctaaataaattatatatcagaaaactttcaatattggtgactacctaaatgtgatttttgctggttactaaaatattcttaccacttaaaagagcaagctaacacattgtcttaagctgatcagggattttttgtatataagtctgtgttaaatctgtataattcagtcgatttcagttctgataatgttaagaataaccattatgaaaaggaaaatttgtcctgtatagcatcattatttttagcctttcctgttaataaagctttactattctgtcctgggcttatattacacatataactgttatttaaatacttaaccactaattttgaaaattaccagtgtgatacataggaatcattattcagaatgtagtctggtctttaggaagtattaataagaaaatttgcacataacttagttgattcagaaaggacttgtatgctgtttttctcccaaatgaagactctttttgacactaaacactttttaaaaagcttatctttgccttctccaaacaagaagcaatagtctccaagtcaatataaattctacagaaaatagtgttctttttctccagaaaaatgcttgtgagaatcattaaaacatgtgacaatttagagattctttgttttatttcactgattaatatactgtggcaaattacacagattattaaatttttttacaagagtatagtatatttatttgaaatgggaaaagtgcattttactgtattttgtgtattttgtttatttctcagaatatggaaagaaaattaaaatgtgtcaataaatattttctagagagtaa

SEQ ID NO: 324 - protein, 305 aa, Homo Sapien
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAWYFGSLLVIFCVELACGVWTYEQELMVPVQWSDMVTLKARMTNYGLPRYRWLTHAWNFFQREFKCCGVVYFTDWLEMTEMDWPPDSCCVREFPGCSKQAHQEDLSDLYQEGCGKKMYSFLRGTKQLQVLRFLGISIGVTQILAMILTITLLWALYYDRREPGTDQMMSLKNDNSQHLSCPSVELLKPSLSRIFEHTSMANSFNTHFEMEEL

SEQ ID NO: 325 - DNA, 2212 bp, Homo Sapien
agcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggatttcgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccagcgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcata

SEQ ID NO: 326 - protein, 557 aa, Homo Sapien
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 327 - DNA, 2339 bp, Homo Sapien
ccaaggccagagctgtggacaccttatcccactcatcctcatcctcttcctctgataaagcccctaccagtgctgataaagtctttctcgtgagagcctagaggccttaaaaaaaaaagtgcttgaaagagaaggggacaaaggaacaccagtattaagaggattttccagtgtttctggcagttggtccagaaggatgcctccattcctgcttctcacctgcctcttcatcacaggcacctccgtgtcacccgtggccctagatccttgttctgcttacatcagcctgaatgagccctggaggaacactgaccaccagttggatgagtctcaaggtcctcctctatgtgacaaccatgtgaatggggagtggtaccacttcacgggcatggcgggagatgccatgcctaccttctgcataccagaaaaccactgtggaacccacgcacctgtctggctcaatggcagccaccccctagaaggcgacggcattgtgcaacgccaggcttgtgccagcttcaatgggaactgctgtctctggaacaccacggtggaagtcaaggcttgccctggaggctactatgtgtatcgtctgaccaagcccagcgtctgcttccacgtctactgtggtcatttttatgacatctgcgacgaggactgccatggcagctgctcagataccagcgagtgcacatgcgctccaggaactgtgctaggccctgacaggcagacatgctttgatgaaaatgaatgtgagcaaaacaacggtggctgcagtgagatctgtgtgaacctcaaaaactcctaccgctgtgagtgtggggttggccgtgtgctaagaagtgatggcaagacttgtgaagacgttgaaggatgccacaataacaatggtggctgcagccactcttgccttggatctgagaaaggctaccagtgtgaatgtccccggggcctggtgctgtctgaggataaccacacttgccaagtccctgtgttgtgcaaatcaaatgccattgaagtgaacatccccagggagctggttggtggcctggagctcttcctgaccaacacctcctgccgaggagtgtccaacggcacccatgtcaacatcctcttctctctcaagacatgtggtacagtggtcgatgtggtgaatgacaagattgtggccagcaacctcgtgacaggtctacccaagcagaccccggggagcagcggggacttcatcatccgaaccagcaagctgctgatcccggtgacctgcgagtttccacgcctgtacaccatttctgaaggatacgttcccaaccttcgaaactccccactggaaatcatgagccgaaatcatgggatcttcccattcactctggagatcttcaaggacaatgagtttgaagagccttaccgggaagctctgcccaccctcaagcttcgtgactccctctactttggcattgagcccgtggtgcacgtgagcggcttggaaagcttggtggagagctgctttgccacccccacctccaagatcgacgaggtcctgaaatactacctcatccgggatggctgtgtttcagatgactcggtaaagcagtacacatcccgggatcacctagcaaagcacttccaggtccctgtcttcaagtttgtgggcaaagaccacaaggaagtgtttctgcactgccgggttcttgtctgtggagtgttggacgagcgttcccgctgtgcccagggttgccaccggcgaatgcgtcgtggggcaggaggagaggactcagccggtctacagggccagacgctaacaggcggcccgatccgcatcgactgggaggactagttcgtagccatacctcgagtccctgcattggacggctctgctctttggagcttctccccccaccgccctctaagaacatctgccaacagctgggttcagacttcacactgtgagttcagactcccagcaccaactcactctgattctggtccattcagtgggcacaggtcacagcactgctgaacaatgtggcctgggtggggtttcatctttctagggttgaaaactaaactgtccacccagaaagacactcaccccatttccctcatttctttcctacacttaaatacctcgtgtatggtgcaatcagaccacaaaatcagaagctgggtataatatttcaagttacaaaccctagaaaaattaaacagttactgaaattatgacttaaatacccaatgactccttaaatatgtaaattatagttataccttgaaatttcaattcaaatgcagactaattatagggaatttggaagtgtatcaataaaacagtatataatttt

SEQ ID NO: 328 - protein, 545 aa, Homo Sapien
MPPFLLLTCLFITGTSVSPVALDPCSAYISLNEPWRNTDHQLDESQGPPLCDNHVNGEWYHFTGMAGDAMPTFCIPENHCGTHAPVWLNGSHPLEGDGIVQRQACASFNGNCCLWNTTVEVKACPGGYYVYRLTKPSVCFHVYCGHFYDICDEDCHGSCSDTSECTCAPGTVLGPDRQTCFDENECEQNNGGCSEICVNLKNSYRCECGVGRVLRSDGKTCEDVEGCHNNNGGCSHSCLGSEKGYQCECPRGLVLSEDNHTCQVPVLCKSNAIEVNIPRELVGGLELFLTNTSCRGVSNGTHVNILFSLKTCGTVVDVVNDKIVASNLVTGLPKQTPGSSGDFIIRTSKLLIPVTCEFPRLYTISEGYVPNLRNSPLEIMSRNHGIFPFTLEIFKDNEFEEPYREALPTLKLRDSLYFGIEPVVHVSGLESLVESCFATPTSKIDEVLKYYLIRDGCVSDDSVKQYTSRDHLAKHFQVPVFKFVGKDHKEVFLHCRVLVCGVLDERSRCAQGCHRRMRRGAGGEDSAGLQGQTLTGGPIRIDWED

SEQ ID NO: 329 - DNA, 2063 bp, Homo Sapien
gagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcaaaaaaaaaaaa

SEQ ID NO: 330 - protein, 432 aa, Homo Sapien
MLQDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 331 - DNA, 1797 bp, Homo Sapien
agtggttcgatgggaaggatctttctccaagtggttcctcttgaggggagcatttctgctggctccaggactttggccatctataaagcttggcaatgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggccctgcaggtgtgaagggagaacaggggagcccagggctggcaggtcccaagggagcccctggacaagctggccagaagggagaccagggagtgaaaggatcttctggggagcaaggagtaaagggagaaaaaggtgaaagaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatcattga

SEQ ID NO: 332 - protein, 520 aa, Homo Sapien
MRNKKILKEDELLSETQQAAFHQIAMEPFEINVPKPKRRNGVNFSLAVVVIYLILLTAGAGLLVVQVLNLQARLRVLEMYFLNDTLAAEDSPSFSLLQSAHPGEHLAQGASRLQVLQAQLTWVRVSHEHLLQRVDNFTQNPGMFRIKGEQGAPGLQGHKGAMGMPGAPGPPGPPAEKGAKGAMGRDGATGPSGPQGPPGVKGEAGLQGPQGAPGKQGATGTPGPQGEKGSKGDGGLIGPKGETGTKGEKGDLGLPGSKGDRGMKGDAGVMGPPGAQGSKGDFGRPGPPGLAGFPGAKGDQGQPGLQGVPGPPGAVGHPGAKGEPGSAGSPGRAGLPGSPGSPGATGLKGSKGDTGLQGQQGRKGESGVPGPAGVKGEQGSPGLAGPKGAPGQAGQKGDQGVKGSSGEQGVKGEKGERGENSVSVRIVGSSNRGRAEVYYSGTWGTICDDEWQNSDAIVFCRMLGYSKGRALYKVGAGTGQIWLDNVQCRGTESTLWSCTKNSWGHHDCSHEEDAGVECSV

SEQ ID NO: 333 - DNA, 2340 bp, Homo Sapien
gggctgttgatttgtgggggattttgaagagaggaggaataggaggaaggggttgaggggctgcctctggcatatgcacacactcacacattctgtcacacccgtcacacacacataccatgttctccatccccccaggtccagccctcagtgctgtcccatccagcagggctaccctgaagctctggctgcagccctcccgtccagtgggcaggcggcttcatccctcctttctctcccaaagcccaactgctgtcactgcatgctctgccaaggaggagggaactgcagtgacagcaggagtaagagtgggaggcaggacagagctgggacacaggtatggagagggggttcagcgagcctagagagggcagactatcagggtgccggcggtgagaatccagggagaggagcggaaacagaagaggggcagaagaccggggcacttgtgggttgcagagcccctcagccatgttgggagccaagccacactggctaccaggtcccctacacagtcccgggctgcccttggttctggtgcttctggccctgggggccgggtgggcccaggaggggtcagagcccgtcctgctggagggggagtgcctggtggtctgtgagcctggccgagctgctgcaggggggcccgggggagcagccctgggagaggcaccccctgggcgagtggcatttgctgcggtccgaagccaccaccatgagccagcaggggaaaccggcaatggcaccagtggggccatctacttcgaccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggaatctactgggtggttggaaatactcaagtttctctggcttcctcatcttccctctctgaggacccaagtctttcaagcacaagaatccagcccctgacaactttcttctgccctctcttgccccagaaacagcagaggcaggagagagactccctctggctcctatcccacctctttgcatgggaccctgtgccaaacacccaagtttaagagaagagtagagctgtggcatctccagaccaggcctttccacccacccacccccagttaccctcccagccacctgctgcatctgttcctgcctgcagccctaggatcagggcaaggtttggcaagaaggaagatctgcactactttgcggcctctgctcctccggttcccccaccccagcttcctgctcaatgctgatcagggacaggtggcgcaggtgagcctgacaggcccccacaggagcccagatggacaagcctcagcgtaccctgcaggcttcttcctgtgaggaaagccagcatcacggatctcagccagcaccgtcagaagctgagccagcaccgtatgggctagggtgggaggctcagccacaggcagaagggtgggaagggcctggagtctgtggctggtgaggaaggaaggagggtgtattgtctagactgaacatggtacacattctgcatgtatagcagagcagccagcaggtagcaatcctggctgtccttctatgctggatcccagatggactctggcccttacctccccacctgagattagggtgagtgtgtttgctctggctgagagcagagctgagagcaggtatacagagctggaagtggaccatggaaaacatcgataaccatgcatcctcttgcttggccacctcctgaaactgctccacctttgaagtttgaactttagtccctccacactctgactgctgcctccttcctcccagctctctcactgagttatcttcactgtacctgttccagcatatccccactatctctctttctcctgatctgtgctgtcttattctcctccttaggcttcctattacctgggattccatgattcattccttcagaccctctcctgccagtatgctaaaccctccctctctctttcttatcccgctgtcccattggcccagcctggatgaatctatcaataaaacaactagagaatggtggtcagtgagacactatagaattactaaggagaagatgcctctggagtttggatcgggtgttacaggtacaagtaggtatgttgcagaggaaaataaatatcaaactgtatactaaaattaaaaa

SEQ ID NO: 334 - protein, 205 aa, Homo Sapien
MLGAKPHWLPGPLHSPGLPLVLVLLALGAGWAQEGSEPVLLEGECLVVCEPGRAAAGGPGGAALGEAPPGRVAFAAVRSHHHEPAGETGNGTSGAIYFDQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPL

SEQ ID NO: 335 - DNA, 1570 bp, Homo Sapien
gctgtttctctcgcgccaccactggccgccggccgcagctccaggtgtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 336 - protein, 388 aa, Homo Sapien
MKTLIAAYSGVLRGERQAEADRSQRSHGGPALSREGSGRWGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 337 - DNA, 3060 bp, Homo Sapien
gggcggcgggatgggggccgggggcggcgggcgccgcactcgctgaggccccgacgcagggccgggccgggcccagggccgaggagcgcggcggccagagcggggccgcggaggcgacgccggggacgcccgcgcgacgagcaggtggcggcggctgcaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagaatcgcttgaacctgggaggtggagattgcagtgagctgagatggcatcactgtactccagcctaggcaacagagcaagactcagtctcaaaaaaaaaaaaaaacaaaaaaaccccagaaattctggagttgaactgtgtagttactgacatgaaaaattcactagaggctgaacagcagatttgagcaggcagaaaaaaatcagcaagcttgaagatggtaccttgagatttttcaggctaatgaaaaaagaatgaaggaaaattaacagcctcagagacccatggtgcaccgtcacacaaatcaacatatgcatgatgagagtcccagaaggagaggagagaaagggtcagaaagaatggccacaagctgatgaaaaacagtaacctacccactcaggaagctcagtgaactccaatgaggatgaatatcagagatccacacctagatatttcataatcaaagtgtcaaatgacaaagaatcttgaaagcagcaagagatgagcaacttatcttgttcaaaggatctttgatcagattaacagctcatttctcctcagaaatcatgggagccaggagatagtgggatgaacactgttgaaggcaaaaccttcaactgtaattattggacttttgagtcttagatggtcctgacctctttgtcttcagggacagtttttcaatttaatccctaataacaattagtcaagcttccttgacctgtaggaaggcctgtctttaggccgggcacagtggcttacacctgtaatcccagcactttgggaggcccagacgggtggatcatttggggtcaggctgatctcaaactcctgagttcaggtgatctgcccgcctcagcctcccaaagtgttgtgattgcaggcgtgagccactgcgcctggccggaatttctttttaaggctgaatgatgggggccaggcacgatggctcacgcctgtgatcccaagtagcttggattgtaaacatgcaccaccatgcctggctaatttttgtatttttagtagagacgtgttagccaggctggtctcgatctcctgacctcaagtgaccacctgcctcagcctcccaaagtactgggattacaggcgtgagccactgtgcctggccttgagcatcttgtgatgtgcttattggccatttgtatatcttctatcttctttggggaaatgtctgttcaagtcctttgcctttttaaatttttattatttatttatttatttattttgagacagggtcttgttctgttgcccaggctggagtacagtggcacagtcttggctcactgcagcctcgacctcctgggctgcagtgatcctcccacctcagcctcccttgtagctgtatttttttgtattttgtattttgtagctgtagtttttgtattttttgtggagacagcatttcaccatgatgcccaggctggtcttgaactcctgagctcaagtgatctgcctgcttcagcctcccaaagtgctgggattacagacatgagccactgcacctggcaaactcccaaaattcaacacacacacacaaaaaaccacctgattcaaaatgggcagaggggccgggtgtggccccaactaccagggagactgaagtgggaggatcgcttgggcatgagaagtcgaggctgcagtgagtcgaggttgtgcgactgcattccagcctggacaacagagtgagaccctgtctc

SEQ ID NO: 338 - protein, 368 aa, Homo Sapien
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAASFGVRRLIGESLEPGRWRLQ

SEQ ID NO: 339 - DNA, 1334 bp, Homo Sapien
gatattctttatttttaagaatctgaagtactatgcatcactccctccaatgtcctggggcagccaccaggcatattcatctttgtgtgtgtttttcttttgctttagcactggggcacttcttgcttatttctttggtaggaaaggggctcagtttgtcttgtggggttggtggcaggcaggccggcttacgcctgatacggccctgggttagaagggaagggaagataaacttttatacaaatggggatagctggggtctgagacctgcttcctcagtaaaattcctgggatctgcctataccttcttttctctaacctggcataccctgcttaaagcctctcagggcttctctctgttcttaggatcaaagtatttagagctacaagagccctcatggtctggcccctgcccccctggccagcttcattgtacatgtggtgttctcttgtcgttcctgtaatgtggtatgccatggggtctttgcacaagcctttcctctttggctggacactgttccctgccccccccatactcttcctacttaatatgtagtcatcctgcagatttcaattctaacatcattttctccagggatcctggcctgacagaatctcatcttgtttaatgctctcataagaccacttgtttcccttttgcagcacttgccactcagttgtatctttatgtgcgtttgtggttgtatgggttgtgtctgttccccagaatgcccagctctgagctgcgtgagggtcaagggcattgctgtgcctgccaggtatagtgcctacatgtggtgggtgctcatgttttagagactaaatggaggaggagatgaggaaaagattgaaatctctcagttcaccagatggtgtagggcccagcattgtaaattcacacgttgactgtgcttgtgaattatctggggatgcaggtcctgattcagtaggcccaggttgggcatctctaacaaactcccacgtgatgctgatgctggtcctatgaactatactaaatagtaagaatctatggagccaggctgggcatggtggctcacacctatgatcccagcactttgggaggctgaggcaggctgatcacctggagtcaggatttcaagactagcctggccaacatggtggaaccccatctgtactaaaaatacacaaattagctgggcatggtggcacatgcctgtagtcccagctacttgggaggctgaagcaagagaatcgcttgaacctgggaggcggaggttgcagtgagccgagatcaggccactgtattccaaccagggtgacagagtgagactctatgtccaaaaaaaaaaaaa

SEQ ID NO: 340 - protein, 143 aa, Homo Sapien
MHHSLQCPGAATRHIHLCVCFSFALALGHFLLISLVGKGLSLSCGVGGRQAGLRLIRPWVRREGKINFYTNGDSWGLRPASSVKFLGSAYTFFSLTWHTLLKASQGFSLFLGSKYLELQEPSWSGPCPPGQLHCTCGVLLSFL

SEQ ID NO: 341 - DNA, 783 bp, Homo Sapien
cgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtgaagcagactgtggtgaatttagcaacacttatgaagtttcttaaagtggctcatacacacttaaaaggcttaatgtttctctggaaagcgtcccagaatattagccagttttctgtc

SEQ ID NO: 342 - protein, 220 aa, Homo Sapien
MAGLSRGSARALLAALLASTLLALLVSPARGRGGRDHGDWDEASRLPPLPPREDAARVARFVTHVSDWGALATISTLEAVRGRPFADVLSLSDGPPGAGSGVPYFYLSPLQLSVSNLQENPYATLTMTLAQTNFCKKHGFDPQSPLCVHIMLSGTVTKVNETEMDIAKHSLFIRHPEMKTWPSSHNWFFAKLNITNIWVLDYFGGPKIVTPEEYYNVTVQ

SEQ ID NO: 343 - DNA, 1768 bp, Homo Sapien
ggctggactggaactcctggtcccaagtgatccacccgcctcagcctcccaaggtgctgtgattataggtgtaagccaccgtgtctggcctctgaacaactttttcagcaactaaaaaagccacaggagttgaactgctaggattctgactatgctgtggtggctagtgctcctactcctacctacattaaaatctgttttttgttctcttgtaactagcctttaccttcctaacacagaggatctgtcactgtggctctggcccaaacctgaccttcactctggaacgagaacagaggtttctacccacaccgtcccctcgaagccggggacagcctcaccttgctggcctctcgctggagcagtgccctcaccaactgtctcacgtctggaggcactgactcgggcagtgcaggtagctgagcctcttggtagctgcggctttcaaggtgggccttgccctggccgtagaagggattgacaagcccgaagatttcataggcgatggctcccactgcccaggcatcagccttgctgtagtcaatcactgccctggggccaggacgggccgtggacacctgctcagaagcagtgggtgagacatcacgctgcccgcccatctaaccttttcatgtcctgcacatcacctgatccatgggctaatctgaactctgtcccaaggaacccagagcttgagtgagctgtggctcagacccagaaggggtctgcttagaccacctggtttatgtgacaggacttgcattctcctggaacatgagggaacgccggaggaaagcaaagtggcagggaaggaacttgtgccaaattatgggtcagaaaagatggaggtgttgggttatcacaaggcatcgagtctcctgcattcagtggacatgtgggggaagggctgccgatggcgcatgacacactcgggactcacctctggggccatcagacagccgtttccgccccgatccacgtaccagctgctgaagggcaactgcaggccgatgctctcatcagccaggcagcagccaaaatctgcgatcaccagccaggggcagccgtctgggaaggagcaagcaaagtgaccatttctcctcccctccttccctctgagaggccctcctatgtccctactaaagccaccagcaagacatagctgacaggggctaatggctcagtgttggcccaggaggtcagcaaggcctgagagctgatcagaagggcctgctgtgcgaacacggaaatgcctccagtaagcacaggctgcaaaatccccaggcaaaggactgtgtggctcaatttaaatcatgttctagtaattggagctgtccccaagaccaaaggagctagagcttggttcaaatgatctccaagggcccttataccccaggagactttgatttgaatttgaaaccccaaatccaaacctaagaaccaggtgcattaagaatcagttattgccgggtgtggtggcctgtaatgccaacattttgggaggccgaggcgggtagatcacctgaggtcaggagttcaagaccagcctggccaacatggtgaaacccctgtctctactaaaaatacaaaaaaactagccaggcatggtggtgtgtgcctgtatcccagctactcgggaggctgagacaggagaattacttgaacctgggaggtgaaggaggctgagacaggagaatcacttcagcctgagcaacacagcgagactctgtctcagaaaaaataaaaaaagaattatggttatttgtaa

SEQ ID NO: 344 - protein, 109 aa, Homo Sapien
MLWWLVLLLLPTLKSVFCSLVTSLYLPNTEDLSLWLWPKPDLHSGTRTEVSTHTVPSKPGTASPCWPLAGAVPSPTVSRLEALTRAVQVAEPLGSCGFQGGPCPGRRRD

SEQ ID NO: 345 - DNA, 2272 bp, Homo Sapien
ccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaacggttttttaatga

SEQ ID NO: 346 - protein, 671 aa, Homo Sapien
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRERADRGEAERGSGGSSGDELREDDEPVKKRGRKGRGRGPPSSSDSEPEAELEREAKKSAKKPQSSSTEPARKPGQKEKRVRPEEKQQAKPVKVERTRKRSEGFSMDRKVEKKKEPSVEEKLQKLHSEIKFALKVDSPDVKRCLNALEELGTLQVTSQILQKNTDVVATLKKIRRYKANKDVMEKAAEVYTRLKSRVLGPKIEAVQKVNKAGMEKEKAEEKLAGEELAGEEAPQEKAEDKPSTDLSAPVNGEATSQKGESAEDKEHEEGRDSEEGPRCGSSEDLHDSVREGPDLDRPGSDRQERERARGDSEALDEES

SEQ ID NO: 347 - DNA, 3871 bp, Homo Sapien
gttggttctcctggatcttcaccttaccaactgcagatcttgggactcatcagcctcaataattatattaaattaacaccatttgaaagagaacattgttttcatcatgaatgctaataaagatgaaagacttaaagccagaagccaagattttcacctttttcctgctttgatgatgctaagcatgaccatgttgtttcttccagtcactggcactttgaagcaaaatattccaagactcaagctaacctacaaagacttgctgctttcaaatagctgtattccctttttgggttcatcagaaggactggattttcaaactcttctcttagatgaggaaagaggcaggctgctcttgggagccaaagaccacatctttctactcagtctggttgacttaaacaaaaattttaagaagatttattggcctgctgcaaaggaacgggtggaattatgtaaattagctgggaaagatgccaatacagaatgtgcaaatttcatcagagtacttcagccctataacaaaactcacatatatgtgtgtggaactggagcatttcatccaatatgtgggtatattgatcttggagtctacaaggaggatattatattcaaactagacacacataatttggagtctggcagactgaaatgtcctttcgatcctcagcagccttttgcttcagtaatgacagatgagtacctctactctggaacagcttctgatttccttggcaaagatactgcattcactcgatcccttgggcctactcatgaccaccactacatcagaactgacatttcagagcactactggctcaatggagcaaaatttattggaactttcttcataccagacacctacaatccagatgatgataaaatatatttcttctttcgtgaatcatctcaagaaggcagtacctccgataaaaccatcctttctcgagttggaagagtttgtaagaatgatgtaggaggacaacgcagcctgataaacaagtggacgacttttcttaaggccagactgatttgctcaattcctggaagtgatggggcagatacttactttgatgagcttcaagatatttatttactccccacaagagatgaaagaaatcctgtagtatatggagtctttactacaaccagctccatcttcaaaggctctgctgtttgtgtgtatagcatggctgacatcagagcagtttttaatggtccatatgctcataaggaaagtgcagaccatcgttgggtgcagtatgatgggagaattccttatccacggcctggtacatgtccaagcaaaacctatgacccactgattaagtccacccgagattttccagatgatgtcatcagtttcataaagcggcactctgtgatgtataagtccgtatacccagttgcaggaggaccaacgttcaagagaatcaatgtggattacagactgacacagatagtggtggatcatgtcattgcagaagatggccagtacgatgtaatgtttcttggaacagacattggaactgtcctcaaagttgtcagcatttcaaaggaaaagtggaatatggaagaggtagtgctggaggagttgcagatattcaagcactcatcaatcatcttgaacatggaattgtctctgaagcagcaacaattgtacattggttcccgagatggattagttcagctctccttgcacagatgcgacacttatgggaaagcttgcgcagactgttgtcttgccagagacccctactgtgcctgggatggaaatgcatgctctcgatatgctcctacttctaaaaggagagctagacgccaagatgtaaaatatggcgacccaatcacccagtgctgggacatcgaagacagcattagtcatgaaactgctgatgaaaaggtgatttttggcattgaatttaactcaacctttctggaatgtatacctaaatcccaacaagcaactattaaatggtatatccagaggtcaggggatgagcatcgagaggagttgaagcccgatgaaagaatcatcaaaacggaatatgggctactgattcgaagtttgcagaagaaggattctgggatgtattactgcaaagcccaggagcacactttcatccacaccatagtgaagctgactttgaatgtcattgagaatgaacagatggaaaatacccagagggcagagcatgaggaggggcaggtcaaggatctattggctgagtcacggttgagatacaaagactacatccaaatccttagcagcccaaacttcagcctcgaccagtactgcgaacagatgtggcacagggagaagcggagacagagaaacaaggggggcccaaagtggaagcacatgcaggaaatgaagaagaaacgaaatcgaagacatcacagagacctggatgagctccctagagctgtagccacgtagttttctacttaatttaaagaaaagaattccttacctataaaaacattgccttctgttttgtatatcccttatagtaattcataaatgcttcccatggagttttgctaaggcacaagacaataatctgaataagacaatatgtgatgaatataagaaagggcaaaaaattcatttgaaccagttttccaagaacaaatcttgcacaagcaaagtataagaattatcctaaaaatagggggtttacagttgtaaatgttttatgttttgagttttggaatttattgtcatgtaaatagttgagctaagcaagccccgaatttgatagtgtataaggtgctttattccctcgaatgtccattaagcatggaatttaccatgcagttgtgctatgttcttatgaacagatatatcattcctattgagaaccagctaccttgtggtagggaataagaggtcagacacaaattaagacaactcccattatcaacaggaactttctcagtgagccattcactcctggagaatggtataggaatttggagaggtgcattatttctttctggccactggggttaaatttagtgtactacaacattgatttactgaagggcactaatgtttcccccaggatttctattgactagtcaggagtaacaggttcacagagagaagttggtgcttagttatgtgttttttagagtatatactaagctctacagggacagaatgcttaataaatactttaataagatatgggaaaatattttaataaaacaaggaaaacataatgatgtataatgcatcctgatgggaaggcatgcagatgggatttgttagaagacagaaggaaagacagccataaattctggctttggggaaaactcatatccccatgaaaaggaagaacaatcacaaataaagtgagagtaatgtaatggagctcttttcactagggtataagtagctgccaatttgtaattcatctgttaaaaaaaatctagattataacaaactgctagcaaaatctgaggaaacataaattcttctgaagaatcataggaagagtagacattttatttataaccaatgatatttcagtatatattttctctcttttaaaaaatatttatcatactctgtatattatttctttttactgcctttattctctcctgtatattggattttgtgattatatttgagtgaataggagaaaacaatatataacacacagagaattaagaaaatgacatttctggggagtggggatatatatttgttgaataacagaacgagtgtaaaattttaacaacggaaagggttaaattaactctttgacatcttcactcaaccttttctcattgctgagttaatctgttgtaattgtagtattgtttttgtaatttaacaataaataagcctgctacatgt

SEQ ID NO: 348 - protein, 777 aa, Homo Sapien [sequence omitted]

SEQ ID NO: 349 - DNA, 3934 bp, Homo Sapien
ccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtgaggtgggggggcacaggtgtcatgtgcaccttcttgtctcagcaagaagagctgagagaggggatcttggagccattgagggtgtcatggagctacagaggggagggaaaggtattttaaggtaacagtgtggcacaatagttaagagcacagtttttggagctagaccgacataggttcaaattctcttctgttgcttcctagttctgtagccccaggtaagggagtgacttaacctctctggacttcaatttcctcatcactaaagtagggccaataatagcacccacctcatagggaagattaaatgacataatgtatgtgatgcaactagcaaagtaccagtcccatagtaagtcatgccccacagtatttccacccacccctgttctctgccttcccaaccaggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctggggacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactctgggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtcccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgctggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggatgcaaggggctgcagagcccaggtgcactgtgtgatgatgggagggggctccgtcctgcaggctggaggtggcatccacactggacagcaggaggaggggagtgagggtaacatttccatttcccttcatgttttgtttcttacgttctttcagcatgctccttaaaaccccagaagccccaatttccccaagccccattttttcttgtctttatctaataaactcaatattaag

SEQ ID NO: 350 - protein, 370 aa, Homo Sapien
MQLAKYQSHSKSCPTVFPPTPVLCLPNQVLQRLEQRRQQASEREAPSIEQRLQEVRESIRRAQVSQVKGAARLALLQGAGLDVERWLKPAMTQAQDEVEQERRLSEARLSQRDLSPTAEDAELSDFEECEETGELFEEPAPQALATRALPCPAHVVFRYQAGREDELTITEGEWLEVIEEGDADEWVKARNQHGEVGFVPERYLNFPDLSLPESSQDSDNPCGAEPTAFLAQALYSYTGQSAEELSFPEGALIRLLPRAQDGVDDGFWRGEFGGRVGVFPSLLVEELLGPPGPPELSDPEQMLPSPSPPSFSPPAPTSVLDGPPAPVLPGDKALDFPGFLDMMAPRLRPMRPPPPPPAKAPDPGHPDPLT

SEQ ID NO: 351 - DNA, 4407 bp, Homo Sapien
cacagggagacccacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcactgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcgggccctgaccactttgacacagccattctgtttacccgtcaggacctgtgtggagtctccacttgcgacacgctgggtatggctgatgtgggcaccgtctgtgacccggctcggagctgtgccattgtggaggatgatgggctccagtcagccttcactgctgctcatgaactgggtcatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatgggcactgtctcttagacaaaccagaggctccattgcatctgcctgtgactttccctggcaaggactatgatgctgaccgccagtgccagctgaccttcgggcccgactcacgccattgtccacagctgccgccgccctgtgctgccctctggtgctctggccacctcaatggccatgccatgtgccagaccaaacactcgccctgggccgatggcacaccctgcgggcccgcacaggcctgcatgggtggtcgctgcctccacatggaccagctccaggacttcaatattccacaggctggtggctggggtccttggggaccatggggtgactgctctcggacctgtgggggtggtgtccagttctcctcccgagactgcacgaggcctgtcccccggaatggtggcaagtactgtgagggccgccgtacccgcttccgctcctgcaacactgaggactgcccaactggctcagccctgaccttccgcgaggagcagtgtgctgcctacaaccaccgcaccgacctcttcaagagcttcccagggcccatggactgggttcctcgctacacaggcgtggccccccaggaccagtgcaaactcacctgccaggcccgggcactgggctactactatgtgctggagccacgggtggtagatgggaccccctgttccccggacagctcctcggtctgtgtccagggccgatgcatccatgctggctgtgatcgcatcattggctccaagaagaagtttgacaagtgcatggtgtgcggaggggacggttctggttgcagcaagcagtcaggctccttcaggaaattcaggtacggatacaacaatgtggtcactatccccgcgggggccacccacattcttgtccggcagcagggaaaccctggccaccggagcatctacttggccctgaagctgccagatggctcctatgccctcaatggtgaatacacgctgatgccctcccccacagatgtggtactgcctggggcagtcagcttgcgctacagcggggccactgcagcctcagagacactgtcaggccatgggccactggcccagcctttgacactgcaagtcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcaggaaataacctcactatcccggctgccctttctgggcaccggggcctcggacttagctgggagaaagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaatctcggctcactgcatcctccgcctcccgggttcaagtgattctcatgcctcagcctcctgagtagctgggattacaggctcctgccaccacgcccagctaatttttgttttgttttgtttggagacagagtctcgctattgtcaccagggctggaatgatttcagctcactgcaaccttcgccacctgggttccagcaattctcctgcctcagcctcccgagtagctgagattataggcacctaccaccacgcccggctaatttttgtatttttagtagagacggggtttcaccatgttggccaggctggtctcgaactcctgaccttaggtgatccactcgccttcatctcccaaagtgctgggattacaggcgtgagccaccgtgcctggccacgcccaactaatttttgtatttttagtagagacagggtttcaccatgttggccaggctgctcttgaactcctgacctcaggtaatcgacctgcctcggcctcccaaagtgctgggattacaggtgtgagccaccacgcccggtacatattttttaaattgaattctactatttatgtgatccttttggagtcagacagatgtggttgcatcctaactccatgtctctgagcattagatttctcatttgccaataataatacctcccttagaagtttgttgtgaggattaaataatgtaaataaagaactagcataacactcaaaaaaaaaaaaaaaaaaaaaaaaaaaaaaaaaaaaaaaaaaaaaaaaaaaaaaaaaaaaaaaaaaaaaaaaaaaaaaaggaaa

SEQ ID NO: 352 - protein, 837 aa, Homo Sapien [sequence omitted]

SEQ ID NO: 353 - DNA, 1174 bp, Homo Sapien
gcggaactggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaaaaaaaaaaaa

SEQ ID NO: 354 - protein, 239 aa, Homo Sapien
MASTAVQLLGFLLSFLGMVGTLITTILPHWRRTAHVGTNILTAVSYLKGLWMECVWHSTGIYQCQIYRSLLALPQDLQAARALMVISCLLSGIACACAVIGMKCTRCAKGTPAKTTFAILGGTLFILAGLLCMVAVSWTTNDVVQNFYNPLLPSGMKFEIGQALYLGFISSSLSLIGGTLLCLSCQDEAPYRPYQAPPRATTTTANTAPAYQPPAAYKDNRAPSVTSATHSGYRLNDYV

SEQ ID NO: 355 - DNA, 2121 bp, Homo Sapien
gagctcccctcaggagcgcgttagcttcacaccttcggcagcaggagggcggcagcttctcgcaggcggcagggcgggcggccaggatcatgtccaccaccacatgccaagtggtggcgttcctcctgtccatcctggggctggccggctgcatcgcggccaccgggatggacatgtggagcacccaggacctgtacgacaaccccgtcacctccgtgttccagtacgaagggctctggaggagctgcgtgaggcagagttcaggcttcaccgaatgcaggccctatttcaccatcctgggacttccagccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtctttgtgcaattgctggagtgtctgtgtttgccaacatgctggtgactaacttctggatgtccacagctaacatgtacaccggcatgggtgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaaagcctcgatttcatctttggagaggccaaatggtcttagcctcagtctctgtctctaaatattccaccataaaacagctgagttatttatgaattagaggctatagctcacattttcaatcctctatttctttttttaaatataactttctactctgatgagagaatgtggttttaatctctctctcacattttgatgatttagacagactccccctcttcctcctagtcaataaacccattgatgatctatttcccagcttatccccaagaaaacttttgaaaggaaagagtagacccaaagatgttattttctgctgtttgaattttgtctccccacccccaacttggctagtaataaacacttactgaagaagaagcaataagagaaagatatttgtaatctctccagcccatgatctcggttttcttacactgtgatcttaaaagttaccaaaccaaagtcattttcagtttgaggcaaccaaacctttctactgctgttgacatcttcttattacagcaacaccattctaggagtttcctgagctctccactggagtcctctttctgtcgcgggtcagaaattgtccctagatgaatgagaaaattattttttttaatttaagtcctaaatatagttaaaataaataatgttttagtaaaatgatacactatctctgtgaaatagcctcacccctacatgtggatagaaggaaatgaaaaaataattgctttgacattgtctatatggtactttgtaaagtcatgcttaagtacaaattccatgaaaagctcacacctgtaatcctagcactttgggaggctgaggaggaaggatcacttgagcccagaagttcgagactagcctgggcaacatggagaagccctgtctctacaaaatacagagagaaaaaatcagccagtcatggtggcatacacctgtagtcccagcattccgggaggctgaggtgggaggatcacttgagcccagggaggttggggctgcagtgagccatgatcacaccactgcactccagccaggtgacatagcgagatcctgtctaaaaaaataaaaaataaataatggaacacagcaagtcctaggaagtaggttaaaactaattctttaa

SEQ ID NO: 356 - protein, 261 aa, Homo Sapien
MSTTTCQVVAFLLSILGLAGCIAATGMDMWSTQDLYDNPVTSVFQYEGLWRSCVRQSSGFTECRPYFTILGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 357 - DNA, 2010 bp, Homo Sapien
ggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaacccaatgctttgattgttctagaaagtatagtaatttgttttctaaggtggttcaagcatctactctttttatcatttacttcaaaatgacattgctaaagactgcattattttactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaacgcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccatttctgtttagttttactaaaatctgtaaatactgtatttttctgtttattccaaatttgatgaaactgacaatccaatttgaaagtttgtgtcgacgtctgtctagcttaaatgaatgtgttctatttgctttatacatttatattaataaattgtacatttttctaatt

SEQ ID NO: 358 - protein, 225 aa, Homo Sapien
MATHALEIAGLFLGGVGMVGTVAVTVMPQWRVSAFIENNIVVFENFWEGLWMNCVRQANIRMQCKIYDSLLALSPDLQAARGLMCAASVMSFLAFMMAILGMKCTRCTGDNEKVKAHILLTAGIIFIITGMVVLIPVSWVANAIIRDFYNSIVNVAQKRELGEALYLGWTTALVLIVGGALFCCVFCCNEKSSSYRYSIPSHRTTQKSYHTGKKSPSVYSRSQYV

SEQ ID NO: 359 - DNA, 742 bp, Homo Sapien
cccgcgcccggttctccctcgcagcacctcgaagtgcgcccctcgccctcctgctcgcgccccgccgccatggctgcctcccccgcgcggcctgctgtcctggccctgaccgggctggcgctgctcctgctcctgtgctggggcccaggtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgatgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgttaaaaaga

SEQ ID NO: 360 - protein, 148 aa, Homo Sapien
MAASPARPAVLALTGLALLLLLCWGPGGISGNKLKLMLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHGASVNYDDY

SEQ ID NO: 361 - DNA, 849 bp, Homo Sapien
gagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcggatggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactctcctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcg

SEQ ID NO: 362 - protein, 148 aa, Homo Sapien [sequence omitted]

SEQ ID NO: 363 - DNA, 2575 bp, Homo Sapien
tctgacctgactggaagcgtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccatgttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatggaaaagcccgccagcagtggcgatttgaccagataaatgctgtggatgaacgatgaatgtcaatgtcagaaggaaaagagaattttggccatcaaaatccagctccaagtgaacgtaaagagcttatatatttcatgaagctgatccttttgtgtgtgtgctccttgtgttaggagagaaaaaagctctatgaaagaatataggaagtttctccttttcacaccttatttcattgactgctggctgctta

SEQ ID NO: 364 - protein, 639 aa, Homo Sapien
MLLRKRYRHRPCRLQFLLLLLMLGCVLMMVAMLHPPHHTLHQTVTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDGKARQQWRFDQINAVDER

SEQ ID NO: 365 - DNA, 1257 bp, Homo Sapien
ggagagaggcgcgcgggtgaaaggcgcattgatgcagcctgcggcggcctcggagcgcggcggagccagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctgtataatggaatgtgcttacaagggccagcaggagtgcctggtcgagacgggagccctggggccaatgttattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaaca

SEQ ID NO: 366 - protein, 243 aa, Homo Sapien [sequence omitted]

SEQ ID NO: 367 - DNA, 480 bp, Homo Sapien
gttaaccagcgcagtcctccgtgcgtcccgcccgccgctgccctcactcccggccaggatggcatcctgtctggccctgcgcatggcgctgctgctggtctccggggttctggcccctgcggtgctcacagacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggcaaaaaaaaaaaaaaa

SEQ ID NO: 368 - protein, 121 aa, Homo Sapien
MASCLALRMALLLVSGVLAPAVLTDDVPQEPVPTLWNEPAELPSGEGPVESTSPGREPVDTGPPAPTVAPGPEDSTAQERLDQGGGSLGPGAIAAIVIAALLATCVVLALVVVALRKFSAS

SEQ ID NO: 369 - DNA, 2134 bp, Homo Sapien
ggccgttggttggtgcgcggctgaagggtgtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaaggcacctggcaccaggcagctggggaggagggcagctctccagggagggacccagcctagcacctgaaggatcaatgccatcaccccgcggggacctcccctaagtagcccccagaggcgctgggagtgttgccaccgccctcccctgaagtttgctccatctcacgctgggggtcaacctggggaccccttccctccgggccatggacacacatacatgaaaaccaggccgcatcgactgtcagcaccgctgtggcatcttccagtacgagaccatctcctgcaacaactgcacagactcgcacgtcgcctgctttggctataactgcgagtagggctcaggcatcacacccacccgtgccagggccctactgtccctggggtcccaggctctccttggagggggctccccgccttccacctggctgtcatcgggtagggcggggccgtgggttcaggggcgcaccacttccaagcctgtgtcccacaggtcctcggcgcagtggaagtcagctgtccagggcctcctgaactacataaataactggcacaagtaagtcccctcctcaaaccaacacaggcagtgtgtgtatgtgagcacctcgtgggtgagtatgtgtggggcacaggctggctccctcagctcccacgtcctagaggggctcccgaggaggtggaacctcaacccagctctgcgcaggaggcggctgcagtccttttctccctcaaaggtctccgaccctcagctggaggcgggcatctttcctaaagggtccccatagggtctggttccaccccatcccaggtctgtggtcagagcctgggagggttccctacgatggttaggggtgccccatggaggggctgactgccccacattgcctttcagacaggacacgagcatgaggtaaggccgccctgacctggacttcagggggagggggtaaagggagagaggaggggggctagggggtcctctagatcagtgggggcactgcaggtggggctctccctatacctgggacacctgctggatgtcacctctgcaaccacacccatgtggtggtttcatgaacagaccacgctcctctgccttctcctggcctgggacacacagagccaccccggccttgtgagtgacccagagaagggaggcctcgggagaaggggtgctcgtaagccaacaccagcgtgccgcggcctgcacacccttcggacatcccaggcacgagggtgtcgtggatgtggccacacataggaccacacgtcccagctgggaggagaggcctggggcccccagggagggaggcagggggtgggggacatggagagctgaggcagcctcgtctccccgcagcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctc

SEQ ID NO: 370 - protein, 157 aa, Homo Sapien
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIERHLAPGSWGGGQLSREGPSLAPEGSMPSPRGDLP

SEQ ID NO: 371 - DNA, 1321 bp, Homo Sapien
gccggctgtgcagagacgccatgtaccggctcctgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgaggggcgcggccccggcgcagtcccccgcggcccccgaccctgaggcgtcgcctctggccgagccgccacaggagcagtccctcgccccgtggtctccgcagaccccggcgccgccctgctccaggtgcttcgccagagccatcgagagcagccgcgacctgctgcacaggatcaaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaaggtaaatgaataccttctgctgtgtctagctatatcgcatcttaacactattttattaattaaaagtcaaattttctttgtttccattccaaaatcaacctgccacattttgggagcttttctacatgtctgttttctcatctgtaaagtgaaggaagtaaaacatgtttataaagtaaaaaaa

SEQ ID NO: 372 - protein, 373 aa, Homo Sapien [sequence omitted]

SEQ ID NO: 373 - DNA, 1021 bp, Homo Sapien
gactacggggagagagaggagaccaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgcttcccagtgctcacagatggctggcccatgtgctggaagatgacacagttgccttctctccgaggaacctgccccctctcctttcccaccaggcgtgtgtaacatcccatgtgcctcacctaataaaatggctcttcttatgca

SEQ ID NO: 374 - protein, 256 aa, Homo Sapien
MFQTGGLIVFYGLLAQTMAQFGGLPVPLDQTLPLNVNPALPLSPTGLAGSLTNALSNGLLSGGLLGILENLPLLDILKPGGGTSGGLLGGLLGKVTSVIPGLNNIIDIKVTDPQLLELGLVQSPDGHRLYVTIPLGIKLQVNTPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 375 - DNA, 1449 bp, Homo Sapien
agttctgagaaagaaggaaataaacacaggcaccaaaccactatcctaagttgactgtcctttaaatatgtcaagatccagacttttcagtgtcacctcagcgatctcaacgatagggatcttgtgtttgccgctattccagttggtgctctcggacctaccatgcgaagaagatgaaatgtgtgtaaattataatgaccaacaccctaatggctggtatatctggatcctcctgctgctggttttggtggcagctcttctctgtggagctgtggtcctctgcctccagtgctggctgaggagaccccgaattgattctcacaggcgcaccatggcagtttttgctgttggagacttggactctatttatgggacagaagcagctgtgagtccaactgttggaattcaccttcaaactcaaacccctgacctatatcctgttcctgctccatgttttggccctttaggctccccacctccatatgaagaaattgtaaaaacaacctgattttaggtgtggattatcaatttaaagtattaacgacatctgtaattccaaaacatcaaatttaggaatagttatttcagttgttggaaatgtccagagatctattcatatagtctgaggaaggacaattcgacaaaagaatggatgttggaaaaaattttggtcatggagatgtttaaatagtaaagtagcaggcttttgatgtgtcactgctgtatcatacttttatgctacacaaccaaattaatgcttctccactagtatccaaacaggcaacaattaggtgctggaagtagtttccatcacatttaggactccactgcagtatacagcacaccattttctgctttaaactctttcctagcatggggtccataaaaattattataatttaacaatagcccaagccgagaatccaacatgtccagaaccagaaccagaaagatagtatttgaatgaaggtgaggggagagagtaggaaaaagaaaagtttggagttgaagggtaaaggataaatgaagaggaaaaggaaaagattacaagtctcagcaaaaacaagaggttttatgccccaacctgaagaggaagaaattgtagatagaaggtgaaggagattgctgaagatatagagcacatataatgccaacacggggagaaaagaaaatttccccttttacagtaatgaatgtggcctccatagtccatagtgtttctctggagcctcagggcttggcatttattgcagcatcatgctaagaaccttcggcataggtatctgttcccatgaggactgcagaagtagcaatgagacatcttcaagtggcattttggcagtggccatcagcagggggacagacaaaaacatccatcacagatgacatatgatcttcagctgacaaatttgttgaacaaaacaataaacatcaatagatatctaaaaa

SEQ ID NO: 376 - protein, 146 aa, Homo Sapien
MSRSRLFSVTSAISTIGILCLPLFQLVLSDLPCEEDEMCVNYNDQHPNGWYIWILLLLVLVAALLCGAVVLCLQCWLRRPRIDSHRRTMAVFAVGDLDSIYGTEAAVSPTVGIHLQTQTPDLYPVPAPCFGPLGSPPPYEEIVKTT

SEQ ID NO: 377 - DNA, 1505 bp, Homo Sapien
cgcggatcggacccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaaaaaaaaaaaa

SEQ ID NO: 378 - protein, 260 aa, Homo Sapien
MARPGMERWRDRLALVTGASGGIGAAVARALVQQGLKVVGCARTVGNIEELAAECKSAGYPGTLIPYRCDLSNEEDILSMFSAIRSQHSGVDICINNAGLARPDTLLSGSTSGWKDMFNVNVLALSICTREAYQSMKERNVDDGHIININSMSGHRVLPLSVTHFYSATKYAVTALTEGLRQELREAQTHIRATCISPGVVETQFAFKLHDKDPEKAAATYEQMKCLKPEDVAEAVIYVLSTPAHIQIGDIQMRPTEQVT

SEQ ID NO: 379 - DNA, 2340 bp, Homo Sapien
gagcggagtaaaatctccacaagctgggaacaaacctcgtcccaactcccacccaccggcgtttctccagctcgatctggaggctgcttcgccagtgtgggacgcagctgacgcccgcttattagctctcgctgcgtcgccccggctcagaagctccgtggcggcggcgaccgtgacgagaagcccacggccagctcagttctcttctactttgggagagagagaaagtcagatgccccttttaaactccctcttcaaaactcatctcctgggtgactgagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaaggagtatgctggattcatggaactctaattctgtacataaaaattttaaagttatttgtttgctttcaggcaagtctgttcaatgctgtactatgtccttaaagagaatttggtaacttggttgatgtggtaagcagataggtgagttttgtataaatcttttgtgtttgagatcaagctgaaatgaaaacactgaaaaacatggattcatttctataacacatttatttaagtatataacacgttttttggacaagtgaagaatgtttaatcattctgtcatttgttctcaatagatgtaactgttagactacggctatttgaaaaaatgtgcttattgtactatattttgttattccaattatgagcagagaaaggaaatataatgttgaaaataatgttttgaaatcatgacccaaagaatgtattgatttgcactatccttcagaataactgaaggttaattattgtatatttttaaaaattacacttataagagtataatcttgaaatgggtagcagccactgtccattacctatcgtaaacattggggcaatttaataacagcattaaaatagttgtaaactctaatcttatacttattgaagaataaaagatatttttatgatgagagtaacaataaagtattcatgatttttcacatacatgaatgttcatttaaaagtttaatcctttgagtgtctatgctatcaggaaagcacattatttccatatttgggttaattttgcttttattatattggtctaggaggaagggactttggagaatggaactcttgaggactttagccaggtgtatataataaaggtacttttgtgctgcattaaattgcttggaaagtgttaacattatattatataagagtatcctttatgaaattttgaatttgtataacagatgcattagatattcattttatataatggccacttaaaataagaacatttaaaatataaactatgaagattgactatcttttcaggaaaaaagctgtatatagcacagggaaccctaatcttgggtaattctagtataaaacaaattatacttttatttaaatttcccttgtagcaaatctaattgccacatggtgccctatatttcatagtatttattctctatagtaactgcttaagtgcagctagcttctagatttagactatatagaatttagatattgtattgttcgtcattataatatgctaccacatgtagcaataattacaatattttattaaaataaatatgtgaaatattgtttcatgaaagacagatttccaaatctctcttctcttctctgtactgtctacctttatgtgaagaaattaattatatgccattgccaggt

SEQ ID NO: 380 - protein, 140 aa, Homo Sapien
MFFTISRKNMSQKLSLLLLVFGLIWGLMLLHYTFQQPRHQSSVKLREQILDLSKRYVKALAEENKNTVDVENGASMAGYADLKRTIAVLLDDILQRLVKLENKVDYIVVNGSAANTTNGTSGNLVPVTTNKRTNVSGSIR

SEQ ID NO: 381 - DNA, 1177 bp, Homo Sapien
aacttctacatgggcctcctgctgctggtgctcttcctcagcctcctgccggtggcctacaccatcatgtccctcccaccctcctttgactgcgggccgttcaggtgcagagtctcagttgcccgggagcacctcccctcccgaggcagtctgctcagagggcctcggcccagaattccagttctggtttcatgccagcctgtaaaaggccatggaactttgggtgaatcaccgatgccatttaagagggttttctgccaggatggaaatgttaggtcgttctgtgtctgcgctgttcatttcagtagccaccagccacctgtggccgttgagtgcttgaaatgaggaactgagaaaattaatttctcatgtatttttctcatttatttattaatttttaactgatagttgtacatatttgggggtacatgtgatatttggatacatgtatacaatatataatgatcaaatcagggtaactgggatatccatcacatcaaacatttattttttattctttttagacagagtctcactctgtcacccaggctggagtgcagtggtgccatctcagcttactgcaacctctgcctgccaggttcaagcgattctcatgcctccacctcccaagtagctgggactacaggcatgcaccacaatgcccaactaatttttgtatttttagtagagacggggttttgccatgttgcccaggctggccttgaactcctggcctcaaacaatccacttgcctcggcctcccaaagtgttatgattacaggcgtgagccaccgtgcctggcctaaacatttatcttttctttgtgttgggaactttgaaattatacaatgaattattgttaactgtcatctccctgctgtgctatggaacactgggacttcttccctctatctaactgtatatttgtaccagttaaccaaccgtacttcatccccactcctctctatccttcccaacctctgatcacctcattctactctctacctccatgagatccacttttttagctcccacatgtgagtaagaaaatgcaatatttgtctttctgtgcctggcttatttcacttaacataatgacttcctgttccatccatgttgctgcaaatgacaggatttcgttcttaatttcaattaaaataaccacacatggcaaaaa

SEQ ID NO: 382 - protein, 111 aa, Homo Sapien
MGLLLLVLFLSLLPVAYTIMSLPPSFDCGPFRCRVSVAREHLPSRGSLLRGPRPRIPVLVSCQPVKGHGTLGESPMPFKRVFCQDGNVRSFCVCAVHFSSHQPPVAVECLK

SEQ ID NO: 383 - DNA, 2061 bp, Homo Sapien
ttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaacaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggt

SEQ ID NO: 384 - protein, 649 aa, Homo Sapien
MISAAWSIFLIGTKIGLFLQVAPLSVMAKSCPSVCRCDAGFIYCNDRFLTSIPTGIPEDATTLYLQNNQINNAGIPSDLKNLLKVERIYLYHNSLDEFPTNLPKYVKELHLQENNIRTITYDSLSKIPYLEELHLDDNSVSAVSIEEGAFRDSNYLRLLFLSRNHLSTIPWGLPRTIEELRLDDNRISTISSPSLQGLTSLKRLVLDGNLLNNHGLGDKVFFNLVNLTELSLVRNSLTAAPVNLPGTNLRKLYLQDNHINRVPPNAFSYLRQLYRLDMSNNNLSNLPQGIFDDLDNITQLILRNNPWYCGCKMKWVRDWLQSLPVKVNVRGLMCQAPEKVRGMAIKDLNAELFDCKDSGIVSTIQITTAIPNTVYPAQGQWPAPVTKQPDIKNPKLTKDQQTTGSPSRKTITITVKSVTSDTIHISWKLALPMTALRLSWLKLGHSPAFGSITETIVTGERSEYLVTALEPDSPYKVCMVPMETSNLYLFDETPVCIETETAPLRMYNPTTTLNREQEKEPYKNPNLPLAAIIGGAVALVTIALLALVCWYVHRNGSLFSRNCAYSKGRRRKDDYAEAGTKKDNSILEIRETSFQMLPISNEPISKEEFVIHTIFPPNGMNLYKNNHSESSSNRSYRDSGIPDSDHSHS

SEQ ID NO: 385 - DNA, 1882 bp, Homo Sapien
ccgtcatccccctgcagccacccttcccagagtcctttgcccaggccaccccaggcttcttggcagccctgccgggccacttgtcttcatgtctgccagggggaggtgggaaggaggtgggaggagggcgtgcagaggcagtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgaggggatgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagattctcgctctgttgctcaggctggagtacagtggcgcaatctcggctcactgcaacctttgcctcctgggttcaagcaattctcttgcctcatcctcccgagtagctgggactacaggagcgtgccaccatacctggctaatttttatatttttttagtagagacagggtttcatcatgttgctcatgctggtctcgaactcctgatctcaagagatccgcccacctcaggctcccaaagtgtgggattataggtgtgagccaccgtgtctggctgaaaagcactttcaaagagactgtgttgaataaagggccaaggttcttgccacccagcactcatgggggctctctcccctagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcagggccagggtaggtgggggccgggagggacccaggtgtgaacggatgaataaagttcaactgcaactgaaaaaaaaaaa

SEQ ID NO: 386 - protein, 440 aa, Homo Sapien
MSARGRWEGGGRRACRGSLGLARAQGAERVTSSEQRPAMASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDSRSVAQAGVQWRNLGSLQPLPPGFKQFSCLILPSSWDYRSVPPYLANFYIFLVETGFHHVAHAGLELLISRDPPTSGSQSVGL

SEQ ID NO: 387 - DNA, 1094 bp, Homo Sapien
ggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactatacattatgtatattaattaaaacatcttaatccagaaatcaaaaaaaaaaaaaaaaaaaaaaaaaaaa

SEQ ID NO: 388 - protein, 242 aa, Homo Sapien
MAAALWGFFPVLLLLLLSGDVQSSEVPGAAAEGSGGSGVGIGDRFKIEGRAVVPGVKPQDWISAARVLVDGEEHVGFLKTDGSFVVHDIPSGSYVVEVVSPAYRFDPVRVDITSKGKMRARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKTGKSGAGKRR

SEQ ID NO: 389 - DNA, 1875 bp, Homo Sapien
gtcgtgtgcttggaggaagccgcggaacccccagcgtccgtccatggcgtggagccttgggagctggctgggtggctgcctgctggtgtcagcattgggaatggtaccacctcccgaaaatgtcagaatgaattctgttaatttcaagaacattctacagtgggagtcacctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacgaaacggtcccctcctggatggtggccgtcatcctcatggcctcggtcttcatggtctgcctggcactcctcggctgcttctccttgctgtggtgcgtttacaagaagacaaagtacgccttctcccctaggaattctcttccacagcacctgaaagagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactccagacctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgc

SEQ ID NO: 390 - protein, 325 aa, Homo Sapien [sequence omitted]

SEQ ID NO: 391 - DNA, 1157 bp, Homo Sapien
ctgtgcagctcgaggctccagaggcacactccagagagagccaaggttctgacgcgatgaggaagcacctgagctggtggtggctggccactgtctgcatgctgctcttcagccacctctctgcggtccagacgaggggcatcaagcacagaatcaagtggaaccggaaggccctgcccagcactgcccagatcactgaggcccaggtggctgagaaccgcccgggagccttcatcaagcaaggccgcaagctcgacattgacttcggagccgagggcaacaggtactacgaggccaactactggcagttccccgatggcatccactacaacggctgctctgaggctaatgtgaccaaggaggcatttgtcaccggctgcatcaatgccacccaggcggcgaaccagggggagttccagaagccagacaacaagctccaccagcaggtgctctggcggctggtccaggagctctgctccctcaagcattgcgagttttggttggagaggggcgcaggacttcgggtcaccatgcaccagccagtgctcctctgccttctggctttgatctggctcatggtgaaataagcttgccaggaggctggcagtacagagcgcagcagcgagcaaatcctggcaagtgacccagctcttctcccccaaacccacgcgtgttctgaaggtgcccaggagcggcgatgcactcgcactgcaaatgccgctcccacgtatgcgccctggtatgtgcctgcgttctgatagatgggggactgtggcttctccgtcactccattctcagcccctagcagagcgtctggcacactagattagtagtaaatgcttgatgagaagaacacatcaggcactgcgccacctgcttcacagtacttcccaacaactcttagaggtaggtgtattcccgttttacagataaggaaactgaggcccagagagctgaagtactgcacccagcatcaccagctagaaagtggcagagccaggattcaaccctggcttgtctaaccccaggttttctgctctgtccaattccagagctgtctggtgatcactttatgtctcacagggacccacatccaaacatgtatctctaatgaaattgtgaaagctccatgtttagaaataaatgaaaacacctga

SEQ ID NO: 392 - protein, 176 aa, Homo Sapien
MRKHLSWWWLATVCMLLFSHLSAVQTRGIKHRIKWNRKALPSTAQITEAQVAENRPGAFIKQGRKLDIDFGAEGNRYYEANYWQFPDGIHYNGCSEANVTKEAFVTGCINATQAANQGEFQKPDNKLHQQVLWRLVQELCSLKHCEFWLERGAGLRVTMHQPVLLCLLALIWLMVK

SEQ ID NO: 393 - DNA, 1705 bp, Homo Sapien
tgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaaccaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactccaaaaaaaaaaaaaaaaaaaaaaaaaaa

SEQ ID NO: 394 - protein, 206 aa, Homo Sapien [sequence omitted]

SEQ ID NO: 395 - DNA, 333 bp, Homo Sapien
gccttggcctcccaaagggctgggattataggcgtgaccaccatgtctggtccagagtctcatttcctgatgatttatagactcaaagaaaactcatgttcagaagctctcttctcttctggcctcctctctgtcttctttccctctttcttcttattttaattagtagcatctactcagagtcatgcaagctggaaatctttcattttgcttgtcagtggggtaggtcactgagtcttagtttttattttttgaaatttcaactttcagattcagggggtacatgtgaaggtttgttttatgagtatattgcatgatgctgaggtttggggt

SEQ ID NO: 396 - protein, 73 aa, Homo Sapien
MFRSSLLFWPPLCLLSLFLLILISSIYSESCKLEIFHFACQWGRSLSLSFYFLKFQLSDSGGTCEGLFYEYIA

SEQ ID NO: 397 - DNA, 1750 bp, Homo Sapien
catgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaa

SEQ ID NO: 398 - protein, 542 aa, Homo Sapien
MPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPISITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 399 - DNA, 1515 bp, Homo Sapien
ccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctacatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtag

SEQ ID NO: 400 - protein, 502 aa, Homo Sapien
MSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLPLLLLSLLVATWVLVAGIYLMWRHERIKKTSFSTTTLLPPIKVLVVYPSEICFHHTICYFTEFLQNHCRSEVILEKWQKKKIAEMGPVQWLATQKKAADKVVFLLSNDVNSVCDGTCGKSEGSPSENSQDLFPLAFNLFCSDLRSQIHLHKYVVVYFREIDTKDDYNALSVCPKYHLMKDATAFCAELLHVKQQVSAGKRSQACHDGCCSL

SEQ ID NO: 401 - DNA, 2275 bp, Homo Sapien
gggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagccttggctttggatgagacttttaaagatgcagaggatgctttgcagaaacttcataaatatatgcagaaatctttggaattaagagaaaaacaagctgaaaaggaagaaaagcagaaaacaaagaaaatagaaacaagtgcagaaaagttgcgtaagctcttaaaagaagagaagaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggagtgtactcctatttatttaaaaagttaactataaaacagcctcaggcaggtccttcaggagatattccagaagagggcattgttatcatagatgacagctccattcatgttactgaccctgaagaccttcaagtgggacaagatatggaggtggaagacagtggtattgatgatcctgaccacgggtaggcttaggtttatgtgtgtgtatgtgtcttagtttttaacaaaaaaattaaaaagtaaaaaaactaaaaatagaaaaatgcttagagaataaggatataaagaatatttttgtgcagttgaacaatgagtgcttaagctaaatgtcatcacaaaagagtaaaaaaattttacaaaattaaaaatgtttaaagttaaaaagctctaggaagctaaggtcaatttattattggagaaataaaattatttttatgaatttactgt

SEQ ID NO: 402 - protein, 653 aa, Homo Sapien
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQKSLELREKQAEKEEKQKTKKIETSAEKLRKLLKEEKRLKKKRRKSTSSSSVSSADESVSSSSSSSSSGHKRHKKHKRNRSESSRSSRRHSSRASSNQIDQNRKDECYPVPANTSASFLNHKQEVEKLLGKQDRLQYEKTQIKEKDRCPLSSSSLEIPDDFGVYSYLFKKLTIKQPQAGPSGDIPEEGIVIIDDSSIHVTDPEDLQVGQDMEVEDSGIDDPDHG

SEQ ID NO: 403 - DNA, 1292 bp, Homo Sapien
ccgaggcgggaggagcccgagggggcgcgagccccgcatgaatcattgtagtcaatcattttccagttctcagccgctcagttgtgatcaagggacacgtggtttccgaactgccagctcagaataggaaaataacttgggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgcaaaaa

SEQ ID NO: 404 - protein, 347 aa, Homo Sapien
MDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 405 - DNA, 1788 bp, Homo Sapien
tgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgag

SEQ ID NO: 406 - protein, 374 aa, Homo Sapien
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 407 - DNA, 2609 bp, Homo Sapien
ctcgcagccgagcgcggccggggaagggctctccttccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaaggcgggtacacctgctcctgcaccgacggatattggcttctggaaggccagtgcttagacattgatgaatgtcgctatggttactgccagcagctctgtgcgaatgttcctggatcctattcttgtacatgcaaccctggttttaccctcaatgaggatggaaggtcttgccaagatgtgaacgagtgtgccaccgagaacccctgcgtgcaaacctgcgtcaacacctacggctctctcatctgccgctgtgacccaggatatgaacttgaggaagatggcgttcattgcagtgatatggacgagtgcagcttctctgagttcctctgccaacatgagtgtgtgaaccagcccggcacatacttctgctcctgccctccaggctacatcctgctggatgacaaccgaagctgccaagacatcaacgaatgtgagcacaggaaccacacgtgcaacctgcagcagacgtgctacaatttacaagggggcttcaaatgcatcgaccccatccgctgtgaggagccttatctgaggatcagtgataaccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagaga

SEQ ID NO: 408 - protein, 448 aa, Homo Sapien [sequence omitted]

SEQ ID NO: 409 - DNA, 2076 bp, Homo Sapien
cccacgcgtccgcggacgcgtgggtcgactagttctagatcgcgagcggccgcccgcggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaacaagtgagcttttgtttttggggggagatgtttactacaaaattaacatgagtacatgagtaagaattacattatttaacttaaaggatgaaaggtatggatgatgtgacactgagacaagatgtataaatgaaattttagggtcttgaataggaagttttaatttcttctaagagtaagtgaaaagtgcagttgtaacaaacaaagctgtaacatctttttctgccaataacagaagtttggcatgccgtgaaggtgtttggaaatattattggataagaatagctcaattatcccaaataaatggatgaagctataatagttttggggaaaagattctcaaatgtataaagtcttagaacaaaagaattctttgaaataaaaatattatatataaaagtaaaaaaaaaa

SEQ ID NO: 410 - protein, 476 aa, Homo Sapien
MVGAMWKVIVSLVLLMPGPCDGLFRSLYRSVSMPPKGDSGQPLFLTPYIEAGKIQKGRELSLVGPFPGLNMKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNYYNFLRCTEPEDQLYYVKFLSLPEVRQAIHVGNQTFNDGTIVEKYLREDTVQSVKPWLTEIMNNYKVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 411 - DNA, 3401 bp, Homo Sapien
gcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtacacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcctgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgcgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgcggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtttttgtggcagttttagttttttgttttttttttttttaatcaaaaaacaattttttttaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccacctcctgcggcatgggtgtgtccagtgccaccgctggcctccgctgcttccatcagccctgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaacctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaaaaaaaaaaaaaa

SEQ ID NO: 412 - protein, 546 aa, Homo Sapien
MRQTIIKVIKFILIICYTVYYVHNIKFDVDCTVDIESLTGYRTYRCAHPLATLFKILASFYISLVIFYGLICMYTLWWMLRRSLKKYSFESIREESSYSDIPDVKNDFAFMLHLIDQYDPLYSKRFAVFLSEVSENKLRQLNLNNEWTLDKLRQRLTKNAQDKLELHLFMLSGIPDTVFDLVELEVLKLELIPDVTIPPSIAQLTGLKELWLYHTAAKIEAPALAFLRENLRALHIKFTDIKEIPLWIYSLKTLEELHLTGNLSAENNRYIVIDGLRELKRLKVLRLKSNLSKLPQVVTDVGVHLQKLSINNEGTKLIVLNSLKKMANLTELELIRCDLERIPHSIFSLHNLQEIDLKDNNLKTIEEIISFQHLHRLTCLKLWYNHIAYIPIQIGNLTNLERLYLNRNKIEKIPTQLFYCRKLRYLDLSHNNLTFLPADIGLLQNLQNLAITANRIETLPPELFQCRKLRALHLGNNVLQSLPSRVGELTNLTQIELRGNRLECLPVELGECPLLKRSGLVVEEDLFNTLPPEVKERLWRADKEQA

SEQ ID NO: 413 - DNA, 3462 bp, Homo Sapien
gaatcatccacgcacctgcagctctgctgagagagtgcaagccgtgggggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacccgggaggtggcagttgcagtgagctgagatcgagccactgcactccagcctggtgacagagcgagactccatctcaaaaaaaagaaaaaaaaaaaagaaaaaaatggaaaacatcctcatggccacaaaataaggtctaattcaataaattatagtacattaatgtaatataatattacatgccactaaaaagaataaggtagctgtatatttcctggtatggaaaaaacatattaatatgttataaactattaggttggtgcaaaactaattgtggtttttgccattgaaatggcattgaaataaaagtgtaaagaaatctataccagatgtagtaacagtggtttgggtctgggaggttggattacagggagcatttgatttctatgttgtgtatttctataatgtttgaattgtttagaatgaatctgtatttcttttataagtagaaaaaaaataaagatagtttttacagcct

SEQ ID NO: 414 - protein, 811 aa, Homo Sapien
MRLIRNIYIFCSIVMTAEGDAPELPEERELMTNCSNMSLRKVPADLTPATTTLDLSYNLLFQLQSSDFHSVSKLRVLILCHNRIQQLDLKTFEFNKELRYLDLSNNRLKSVTWYLLAGLRYLDLSFNDFDTMPICEEAGNMSHLEILGLSGAKIQKSDFQKIAHLHLNTVFLGFRTLPHYEEGSLPILNTTKLHIVLPMDTNFWVLLRDGIKTSKILEMTNIDGKSQFVSYEMQRNLSLENAKTSVLLLNKVDLLWDDLFLILQFVWHTSVEHFQIRNVTFGGKAYLDHNSFDYSNTVMRTIKLEHVHFRVFYIQQDKIYLLLTKMDIENLTISNAQMPHMLFPNYPTKFQYLNFANNILTDELFKRTIQLPHLKTLILNGNKLETLSLVSCFANNTPLEHLDLSQNLLQHKNDENCSWPETVVNMNLSYNKLSDSVFRCLPKSIQILDLNNNQIQTVPKETIHLMALRELNIAFNFLTDLPGCSHFSRLSVLNIEMNFILSPSLDFVQSCQEVKTLNAGRNPFRCTCELKNFIQLETYSEVMMVGWSDSYTCEYPLNLRGTRLKDVHLHELSCNTALLIVTIVVIMLVLGLAVAFCCLHFDLPWYLRMLGQCTQTWHRVRKTTQEQLKRNVRFHAFISYSEHDSLWVKNELIPNLEKEDGSILICLYESYFDPGKSISENIVSFIEKSYKSIFVLSPNFVQNEWCHYEFYFAHHNLFHENSDHIILILLEPIPFYCIPTRYHKLKALLEKKAYLEWPKDRRKCGLFWANLRAAINVNVLATREMYELQTFTELNEESRGSTISLMRTDCL

SEQ ID NO: 415 - DNA, 3240 bp, Homo Sapien
cggacgcgtgggcggacgcgtgggcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctc

SEQ ID NO: 416 - protein, 713 aa, Homo Sapien
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 417 - DNA, 3534 bp, Homo Sapien
gtcgttcctttgctctctcgcgcccagtcctcctccctggttctcctcagccgctgtcggaggagagcacccggagacgcgggctgcagtcgcggcggcttctccccgcctgggcggcctcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgttaaaaaaaaaa

SEQ ID NO: 418 - protein, 655 aa, Homo Sapien
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 419 - DNA, 2602 bp, Homo Sapien
atggctggtgacggcggggccgggcaggggaccggggccgcggcccgggagcgggccagctgccgggagccctgaatcaccgcctggcccgactccaccatgaacgtcgcgctgcaggagctgggagctggcagcaacgtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtcactcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattactgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatggccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcc

SEQ ID NO: 420 - protein, 736 aa, Homo Sapien [sequence omitted]

SEQ ID NO: 421 - DNA, 1524 bp, Homo Sapien
ggcgccgcgtaggcccgggaggccgggccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcatgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcaccctactctgacctccttcacgtgcccaggcctgtgggtagtggggagggctgaacaggacaacctctcatcacccccaaaaaaaaaaaaaaaaaaaaaaaaaaaaaaaaaaaaaaaaaaaaaaa

SEQ ID NO: 422 - protein, 327 aa, Homo Sapien
MFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFRFNRAALINVGFLESSNSTDYIAMHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 423 - DNA, 859 bp, Homo Sapien
ccatccctgagatctttttataaaaaacccagtctttgctgaccagacaaagcataccagatctcaccagagagtcgcagacactatgctgcctcccatggccctgcccagtgtgtcctggatgctgctttcctgcctcattctcctgtgtcaggttcaaggtgaagaaacccagaaggaactgccctctccacggatcagctgtcccaaaggctccaaggcctatggctccccctgctatgccttgtttttgtcaccaaaatcctggatggatgcagatctggcttgccagaagcggccctctggaaaactggtgtctgtgctcagtggggctgagggatccttcgtgtcctccctggtgaggagcattagtaacagctactcatacatctggattgggctccatgaccccacacagggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctcagcttggcgtgcagctcatcatggacatgagaccagtgtgaagactcaccctggaagagaatattctccccaaactgccctacctgactaccttgtcatgatcctccttctttttcctttttcttcaccttcatttcaggcttttctctgtcttccatgtcttgagatctcagagaataataataaaaatgttactttataaaaaaaaaaaaaaaaaaaaaa

SEQ ID NO: 424 - protein, 175 aa, Homo Sapien
MLPPMALPSVSWMLLSCLILLCQVQGEETQKELPSPRISCPKGSKAYGSPCYALFLSPKSWMDADLACQKRPSGKLVSVLSGAEGSFVSSLVRSISNSYSYIWIGLHDPTQGSEPDGDGWEWSSTDVMNYFAWEKNPSTILNPGHCGSLSRSTGFLKWKDYNCDAKLPYVCKFKD

SEQ ID NO: 425 - DNA, 1227 bp, Homo Sapien
cggacgcgtgggccgccacctccggaacaagccatggtggcggcgacggtggcagcggcgtggctgctcctgtgggctgcggcctgcgcgcagcaggagcaggacttctacgacttcaaggcggtcaacatccggggcaaactggtgtcgctggagaagtaccgcggatcggtgtccctggtggtgaatgtggccagcgagtgcggcttcacagaccagcactaccgagccctgcagcagctgcagcgagacctgggcccccaccactttaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataaccaccgcgtctcctcctccaccacctcatcccgcccacctgtgtggggctgaccaatgcaaactcaaatggtgcttcaaagggagagacccactgactctccttcctttactcttatgccattggtcccatcattcttgtgggggaaaaattctagtattttgattatttgaatcttacagcaacaaataggaactcctggccaatgagagctcttgaccagtgaatcaccagccgatacgaacgtcttgccaacaaaaatgtgtggcaaatagaagtatatcaagcaataatctcccacccaaggcttctgtaaactgggaccaatgattacctcatagggctgttgtgaggattaggatgaaatacctgtgaaagtgcctaggcagtgccagccaaataggaggcattcaatgaacattttttgcatataaaccaaaaaataacttgttatcaataaaaacttgcatccaacatgaatttccagccgatgataatccaggccaaaggtttagttgttgttatttcctctgtattattttcttcattacaaaagaaatgcaagttcattgtaacaatccaaacaatacctcacgatataaaataaaaatgaaagtatcctcctcaaaaa

SEQ ID NO: 426 - protein, 187 aa, Homo Sapien
MVAATVAAAWLLLWAAACAQQEQDFYDFKAVNIRGKLVSLEKYRGSVSLVVNVASECGFTDQHYRALQQLQRDLGPHHFNVLAFPCNQFGQQEPDSNKEIESFARRTYSVSFPMFSKIAVTGTGAHPAFKYLAQTSGKEPTWNFWKYLVAPDGKVVGAWDPTVSVEEVRPQITALVRKLILLKREDL

SEQ ID NO: 427 - DNA, 678 bp, Homo Sapien
cagttctgaaatcaatggagttaatttagggaatacaaaccagccatgggggtggagattgcctttgcctcagtgattctcacctgcctctcccttctggcagcaggagtctcccaggttgttcttctccagccagttccaactcaggagacaggtcccaaggccatgggagatctctcctgtggctttgccggccactcatgagagtgtttttgtgtaaagtattttttagaatactgttgacttcttcatgatttaataaccatcctttgcgaagttttatgaggctttaggggaatgtcaaccctcaaatttttgttatactagatggcttccatttacccaccactattttaaggtccctttatttttaggttcaaggttcatttgacttgagaaagtgcccttctgcagcttcattgattttgtttatcttcactattaattgtaacgattaaaaaagaataagagcacgcagacctctaggagaatattttatccctgggtgcccctgacacatttatgtagtgatcccacaaatgtgattgttaatttaaatgttattctaatattagtacattcagttgtgatgtaatatgaataaccagaatctatttcttaaaagttttgagtatatttttcaactagatatttgtatagaaagactgaatagtgatg

SEQ ID NO: 428 - protein, 52 aa, Homo Sapien [sequence omitted]

SEQ ID NO: 429 - DNA, 773 bp, Homo Sapien
ccaaagtgatcatttgaaaaagagatatccacatcttcaagcccatataaaggatagaagctgcacagggcagctttacttactccagcaccttcctctcccaggcaaatggtgctgaccatctttgggatacaatctcatggatacgaggtttttaacatcatcagcccaagcaacaatggtggcaatgttcaggagacagtgacaattgataatgaaaaaaataccgccatcgttaacatccatgcaggatcatgctcttctaccacaatttttgactataaacatggctacattgcatccagggtgctctcccgaagagcctgctttatcctgaagatggaccatcagaacatccctcctctgaacaatctccaatggtacatctatgagaaacaggctctggacaacatgttctccaacaaatacacctgggtcaagtacaaccctctggagtctctgatcaaagacgtggattggttcctgcttgggtcacccattgagaaactctgcaaacatatccctttgtataagggggaagtggttgaaaacacacataatgtcggtgctggaggctgtgcaaaggctgggctcctgggcatcttgggaatttcaatctgtgcagacattcatgtttaggatgattagccctcttgttttatcttttcaaagaaatacatccttggtttacactcaaaagtcaaattaaattctttcccaatgccccaactaattttgagattcagtcagaaaatataaatgctgtatttata

SEQ ID NO: 430 - protein, 176 aa, Homo Sapien [sequence omitted]

SEQ ID NO: 431 - DNA, 683 bp, Homo Sapien
gcgtggggatgtctaggagctcgaaggtggtgctgggcctctcggtgctgctgacggcggccacagtggccggcgtacatgtgaagcagcagtgggaccagcagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatcc

SEQ ID NO: 432 - protein, 81 aa, Homo Sapien
MSRSSKVVLGLSVLLTAATVAGVHVKQQWDQQRLRDGVIRDIERQIRKKENIRLLGEQIILTEQLEAEREKMLLAKGSQKS

SEQ ID NO: 433 - DNA, 3608 bp, Homo Sapien
gaattcgtgtctcggcactcactcccggccgcccggacagggagctttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcaatgtacctaatatataccaggacaccacaatttcttggtggaaagatgggaaggaattgcttgggggacatcatcgaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatcccccggcgtgctaactgttccaggcctgacggagatggcggtcttcagttgtgaggcccacaatgacaaagggctgaccgtgtcccagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgggtaatggctcagtcatgatttttaacacctctgccttaccacatctgtaccaaatcaagcagctgcaagccctggctaattacagcattggtgtttcctgcatgaatgaaataggctggtctgcagtgagcccttggattctagcaagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacatcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatacgtacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggccccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaaggaagctgtcattaaaaatacataatatatatttatttaaagagaaaaaatatgtgtatatcatgaaaaagacaaggatattttaataaaacattacttatttcatttcacttatcttgcatatcttaaaattaagcttcagctgctccttgatattaacctttgtacagagttgaagttgttttttcaacttcttttctttttcattactattaaatgtaaaaatatttgtaaaatgaaatgccatatttgacttggcttctggtcttgatgtatttgataagaatgattaattttctgatatggcttccataataaaattgaaatagga

SEQ ID NO: 434 - protein, 999 aa, Homo Sapien
MGPAPLPLLLGLFLPALWRRAITEAREEAKPYPLFPGPFPGSLQTDHTPLLSLPHASGYQPALMFSPTQPGRPHTGNVAIPQVTSVESKPLPPLAFKHTVGHIILSEHKGVKFNCSINVPNIYQDTTISWWKDGKELLGGHHRITQFYPDDEVTAIIASFSITSVQRSDNGSYICKMKINNEEIVSDPIYIEVQGLPHFTKQPESMNVTRNTAFNLTCQAVGPPEPVNIFWVQNSSRVNEQPEKSPGVLTVPGLTEMAVFSCEAHNDKGLTVSQGVQINIKAIPSPPTEVSIRNSTAHSILISWVPGFDGYSPFRNCSIQVKEADPLGNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSHREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIRTRGMTPYPGVQNHEMYDYLLHGHRLKQPEDCLDELYEIMYSCWRTDPLDRPTFSVLRLQLEKLLESLPDVRNQADVIYVNTQLLESSEGLAQGPTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 435 - DNA, 1869 bp, Homo Sapien
aatgtgagaggggctgatggaagctgataggcaggactggagtgttagcaccagtactggatgtgacagcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggaggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcacttccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccagtgacggatacaagcagatcatgccttatgacctctaccatccccttcctcggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccgtgcacagtgacatgtggccagggcctcagataccgtgtggtcctctgcatcgaccatcgaggaatgcacacaggaggctgtagcccaaaaacaaagccccacataaaagaggaatgcatcgtacccactccctgctataaacccaaagagaaacttccagtcgaggccaagttgccatggttcaaacaagctcaagagctagaagaaggagctgctgtgtcagaggagccctcgtaagttgtaaaagcacagactgttctatatttgaaactgttttgtttaaagaaagcagtgtctcactggttgtagctttcatgggttctgaactaagtgtaatcatctcaccaaagctttttggctctcaaattaaagattgattagtttcaaaaaaaaaaa

SEQ ID NO: 436 - protein, 525 aa, Homo Sapien [sequence omitted]

SEQ ID NO: 437 - DNA, 1158 bp, Homo Sapien
aactggaaggaaagaaagaaaggtcagctttggcccagatgtggttaccccttggtctcctgtctttatgtctttctcctcttcctattctgtcatctccctcacttaagtctcaggcctgtcagcagctcctgtggacattgccatcccctctggtagccttcagagcaaacaggacaacctatgttatggatgtttccaccaaccagggtagtggcatggagcaccgtaaccatctgtgcttctgtgatctctatgacagagccacttctccacctctgaaatgttccctgctctgaaatctggcatgagatggcacaggtgaccacgcagaagccaccagaatcttgcctgccctattcctcctcccaagtctgttctcttattgtcaacctcagcacaacaggctggcgccaatggcattacagagaaagcaatctgtgtggctagtgggcagattaccatgcaagccccaggagaaatggaggagctttgtagccacctccctgtcagccagtattaacatgtccccttccccctgccccgccgtagattcaggacattcgcccctgtgtgccaccaaaccaggactttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaatgtagctggagaagattgatgaaagtgcaggtgtgtaaggaaatagaacagtctgctgggagtcagacctggaattctgattccaaactctttattactttgggaagtcactcagcctccccgtagccatctccagggtgacggaacccagtgtattacctgctggaaccaaggaaactaacaatgtaggttactagtgaataccccaatggtttctccaattatgcccatgccaccaaaacaataaaacaaaattctctaacactgaaa

SEQ ID NO: 438 - protein, 86 aa, Homo Sapien
MWLPLGLLSLCLSPLPILSSPSLKSQACQQLLWTLPSPLVAFRANRTTYVMDVSTNQGSGMEHRNHLCFCDLYDRATSPPLKCSLL

SEQ ID NO: 439 - DNA, 4277 bp, Homo Sapien
gtttctcatagttggcgtcttctaaaggaaaaacactaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaactagaagaagtggagtgttgccagggacggcagtatctctttgtgtgaccctggcggcctatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgaagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaagcaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaaa

SEQ ID NO: 440 - protein, 1115 aa, Homo Sapien [sequence omitted]

SEQ ID NO: 441 - DNA, 1579 bp, Homo Sapien
gagagaatagctacagattctccatcctcagtctttgcaaggcgacagctgtgccagccgggctctggcaggctcctggcagcatggcagtgaagcttgggaccctcctgctggcccttgccctgggcctggcccagccagcctctgcccgccggaagctgctggtgtttctgctggatggttttcgctcagactacatcagtgatgaggcgctggagtcattgcctggtttcaaagagattgtgagcaggggagtaaaagtggattacttgactccagacttccctagtctctcgtatcccaattattataccctaatgactggccgccattgtgaagtccatcagatgatcgggaactacatgtgggaccccaccaccaacaagtcctttgacattggcgtcaacaaagacagcctaatgcctctctggtggaatggatcagaacctctgtgggtcactctgaccaaggccaaaaggaaggtctacatgtactactggccaggctgtgaggttgagattctgggtgtcagacccacctactgcctagaatataaaaatgtcccaacggatatcaattttgccaatgcagtcagcgatgctcttgactccttcaagagtggccgggccgacctggcagccatataccatgagcgcattgacgtggaaggccaccactacgggcctgcatctccgcagaggaaagatgccctcaaggctgtagacactgtcctgaagtacatgaccaagtggatccaggagcggggcctgcaggaccgcctgaacgtcattattttctcggatcacggaatgaccgacattttctggatggacaaagtgattgagctgaataagtacatcagcctgaatgacctgcagcaagtgaaggaccgcgggcctgttgtgagcctttggccggcccctgggaaacactctgagatatataacaaactgagcacagtggaacacatgactgtctacgagaaagaagccatcccaagcaggttctattacaagaaaggaaagtttgtctctcctttgactttagtggctgatgaaggctggttcataactgagaatcgagagatgcttccgttttggatgaacagcaccggcaggcgggaaggttggcagcgtggatggcacggctacgacaacgagctcatggacatgcggggcatcttcctggccttcggacctgatttcaaatccaacttcagagctgctcctatcaggtcggtggacgtctacaatgtcatgtgcaatgtggtgggcatcaccccgctgcccaacaacggatcctggtccagggtgatgtgcatgctgaagggccgcgccggcactgccccgcctgtctggcccagccactgtgccctggcactgattcttctcttcctgcttgcataactgatcatattgcttgtctcagaaaaaaacaccatcagcaaagtgggcctccaaagccagatgattttcattttatgtgtgaataatagcttcattaacacaatcaagaccatgcacattgtaaatacattattcttggataattctatacataaaagttcctacttgttaaa

SEQ ID NO: 442 - protein, 440 aa, Homo Sapien [sequence omitted]

SEQ ID NO: 443 - DNA, 972 bp, Homo Sapien
agtgactgcagccttcctagatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagagggaaagacaggacctttcttaccttcagtgagggttcctcggccccttcatcccaatcagcttggatccacaggaaagtcttccctgggaacagaggagcagagacctttataagactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttttgcatatgaaaaaaaaaaaaaaaaaaaaaaaaaaaaaaaaaaaaaaaaaaaa

SEQ ID NO: 444 - protein, 135 aa, Homo Sapien
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPEGKTGPFLPSVRVPRPLHPNQLGSTGKSSLGTEEQRPL

SEQ ID NO: 445 - DNA, 446 bp, Homo Sapien
tggacttctctggaccacagtcctctgccagacccctgccagaccccagtccaccatgatccatctgggtcacatcctcttcctgcttttgctcccagtggctgcagctcagacgactccaggagagagatcatcactccctgccttttaccctggcacttcaggctcttgttccggatgtgggtccctctctctgccgctcctggcaggcctcgtggctgctgatgcggtggcatcgctgctcatcgtgggggcggtgttcctgtgcgcacgcccacgccgcagccccgcccaagatggcaaagtctacatcaacatgccaggcaggggctgaccctcctgcagcttggacctttgacttctgaccctctcatcctggatggtgtgtggtggcacaggaacccccgccccaacttttggattgtaataaaacaattgaaacacca

SEQ ID NO: 446 - protein, 92 aa, Homo Sapien
MIHLGHILFLLLLPVAAAQTTPGERSSLPAFYPGTSGSCSGCGSLSLPLLAGLVAADAVASLLIVGAVFLCARPRRSPAQDGKVYINMPGRG

SEQ ID NO: 447 - DNA, 1047 bp, Homo Sapien
gccaggtgtgcaggccgctccaagcccagcctgccccgctgccgccaccatgacgctcctccccggcctcctgtttctgacctggctgcacacatgcctggcccaccatgacccctccctcagggggcacccccacagtcacggtaccccacactgctactcggctgaggaactgcccctcggccaggcccccccacacctgctggctcgaggtgccaagtgggggcaggctttgcctgtagccctggtgtccagcctggaggcagcaagccacagggggaggcacgagaggccctcagctacgacccagtgcccggtgctgcggccggaggaggtgttggaggcagacacccaccagcgctccatctcaccctggagataccgtgtggacacggatgaggaccgctatccacagaagctggccttcgccgagtgcctgtgcagaggctgtatcgatgcacggacgggccgcgagacagctgcgctcaactccgtgcggctgctccagagcctgctggtgctgcgccgccggccctgctcccgcgacggctcggggctccccacacctggggcctttgccttccacaccgagttcatccacgtccccgtcggctgcacctgcgtgctgccccgttcagtgtgaccgccgaggccgtggggcccctagactggacacgtgtgctccccagagggcaccccctatttatgtgtatttattgttatttatatgcctcccccaacactacccttggggtctgggcattccccgtgtctggaggacagccccccactgttctcctcatctccagcctcagtagttgggggtagaaggagctcagcacctcttccagcccttaaagctgcagaaaaggtgtcacacggctgcctgtaccttggctccctgtcctgctcccggcttcccttaccctatcactggcctcaggccccgcaggctgcctcttcccaacctccttggaagtacccctgtttcttaaacaattatttaagtgtacgtgtattattaaactgatgaacacatccccaaaa

SEQ ID NO: 448 - protein, 197 aa, Homo Sapien
MTLLPGLLFLTWLHTCLAHHDPSLRGHPHSHGTPHCYSAEELPLGQAPPHLLARGAKWGQALPVALVSSLEAASHRGRHERPSATTQCPVLRPEEVLEADTHQRSISPWRYRVDTDEDRYPQKLAFAECLCRGCIDARTGRETAALNSVRLLQSLLVLRRRPCSRDGSGLPTPGAFAFHTEFIHVPVGCTCVLPRSV

SEQ ID NO: 449 - DNA, 1690 bp, Homo Sapien
tgcagagcttgtggaggccatggggcgcgtcgtcgcggagctcgtctcctcgctgctggggttgtggctgttgctgtgcagctgcggatgccccgagggcgccgagctgcgtgctccgccagataaaatcgcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatcaatgcctttgtgggggcggtgtcactgtcctgttctgattctggcctttgggcagtagaaggtggcaataaacttgtttgctcagggcttctgcaggcatccaaaagcaatcttatatctggctcagtaatgtacatcgaggagaaaacaaagaccaagtacacaggaaatccaacaaagatgtatgaagtggtctaccaaattggaactgagactcgttcagacttctatgacatcgtcttggtggccactccgttgaatcgaaaaatgtcgaatattacttttctcaactttgatcctccaattgaggaattccatcaatattatcaacatatagtgacaactttagttaagggggaattgaatacatctatctttagctctagacccatagataaatttggccttaatacagttttaaccactgataattcagatttgttcattaacagtattgggattgtgccctctgtgagagaaaaggaagatcctgagccatcaacagatggaacatatgtttggaagatcttttcccaagaaactcttactaaagcacaaattttaaagctctttctgtcctatgattatgctgtgaagaagccatggcttgcatatcctcactataagcccccggagaaatgcccctctatcattctccatgatcgactttattacctcaatggcatagagtgtgcagcaagtgccatggagatgagtgccattgcagcccacaacgctgcactccttgcctatcaccgctggaacgggcacacagacatgattgatcaggatggcttatatgagaaacttaaaactgaactatgaagtgacacactcctttttcccctcctagttccaaatgactatcagtggcaaaaaagaacaaaatctgagcagagatgattttgaaccagatattttgccattatcattgtttaataaaagtaatccctgctggtcataggaaaaaaaaaaaaa

SEQ ID NO: 450 - protein, 505 aa, Homo Sapien
MGRVVAELVSSLLGLWLLLCSCGCPEGAELRAPPDKIAIIGAGIGGTSAAYYLRQKFGKDVKIDLFEREEVGGRLATMMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYTGNPTKMYEVVYQIGTETRSDFYDIVLVATPLNRKMSNITFLNFDPPIEEFHQYYQHIVTTLVKGELNTSIFSSRPIDKFGLNTVLTTDNSDLFINSIGIVPSVREKEDPEPSTDGTYVWKIFSQETLTKAQILKLFLSYDYAVKKPWLAYPHYKPPEKCPSIILHDRLYYLNGIECAASAMEMSAIAAHNAALLAYHRWNGHTDMIDQDGLYEKLKTEL

SEQ ID NO: 451 - protein, 1743 aa, Homo Sapien
CAACCATGCAAGGACAGGGCAGGAGAAGAGGAACCTGCAAAGACATATTTTGTTCCAAAATGGCATCTTACCTTTATGGAGTACTCTTTGCTGTTGGCCTCTGTGCTCCAATCTACTGTGTGTCCCCGGCCAATGCCCCCAGTGCATACCCCCGCCCTTCCTCCACAAAGAGCACCCCTGCCTCACAGGTGTATTCCCTCAACACCGACTTTGCCTTCCGCCTATACCGCAGGCTGGTTTTGGAGACCCCGAGTCAGAACATCTTCTTCTCCCCTGTGAGTGTCTCCACTTCCCTGGCCATGCTCTCCCTTGGGGCCCACTCAGTCACCAAGACCCAGATTCTCCAGGGCCTGGGCTTCAACCTCACACACACACCAGAGTCTGCCATCCACCAGGGCTTCCAGCACCTGGTTCACTCACTGACTGTTCCCAGCAAAGACCTGACCTTGAAGATGGGAAGTGCCCTCTTCGTCAAGAAGGAGCTGCAGCTGCAGGCAAATTTCTTGGGCAATGTCAAGAGGCTGTATGAAGCAGAAGTCTTTTCTACAGATTTCTCCAACCCCTCCATTGCCCAGGCGAGGATCAACAGCCATGTGAAAAAGAAGACCCAAGGGAAGGTTGTAGACATAATCCAAGGCCTTGACCTTCTGACGGCCATGGTTCTGGTGAATCACATTTTCTTTAAAGCCAAGTGGGAGAAGCCCTTTCACCTTGAATATACAAGAAAGAACTTCCCATTCCTGGTGGGCGAGCAGGTCACTGTGCAAGTCCCCATGATGCACCAGAAAGAGCAGTTCGCTTTTGGGGTGGATACAGAGCTGAACTGCTTTGTGCTGCAGATGGATTACAAGGGAGATGCCGTGGCCTTCTTTGTCCTCCCTAGCAAGGGCAAGATGAGGCAACTGGAACAGGCCTTGTCAGCCAGAACACTGATAAAGTGGAGCCACTCACTCCAGAAAAGGTGGATAGAGGTGTTCATCCCCAGATTTTCCATTTCTGCCTCCTACAATCTGGAAACCATCCTCCCGAAGATGGGCATCCAAAATGCCTTTGACAAAAATGCTGATTTTTCTGGAATTGCAAAGAGAGACTCCCTGCAGGTTTCTAAAGCAACCCACAAGGCTGTGCTGGATGTCAGTGAAGAGGGCACTGAGGCCACAGCAGCTACCACCACCAAGTTCATAGTCCGATCGAAGGATGGTCCCTCTTACTTCACTGTCTCCTTCAATAGGACCTTCCTGATGATGATTACAAATAAAGCCACAGACGGTATTCTCTTTCTAGGGAAAGTGGAAAATCCCACTAAATCCTAGGTGGGAAATGGCCTGTTAACTGATGGCACATTGCTAATGCACAAGAAATAACAAACCACATCCCTCTTTCTGTTCTGAGGGTGCATTTGACCCCAGTGGAGCTGGATTCGCTGGCAGGGATGCCACTTCCAAGGCTCAATCACCAAACCATCAACAGGGACCCCAGTCACAAGCCAACACCCATTAACCCCAGTCAGTGCCCTTTTCCACAAATTCTCCCAGGTAACTAGCTTCATGGGATGTTGCTGGGTTACCATATTTCCATTCCTTGGGGCTCCCAGGAATGGAAATACGCCAACCCAGGTTAGGCACCTCTATTGCAGAATTACAATAACACATTCAATAAAACTAAAATATGAATTCAAAAAAAAAAAAAAAAAAAAAAAAAAAAAAAAAAAAAAAAAAAAAAAAAAAAAAAAAAAAAAAAAAA

SEQ ID NO: 452 - protein, 417 aa, Homo Sapien
MASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHLEYTRKNFPFLVGEQVTVQVPMMHQKEQFAFGVDTELNCFVLQMDYKGDAVAFFVLPSKGKMRQLEQALSARTLIKWSHSLQKRWIEVFIPRFSISASYNLETILPKMGIQNAFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 453 - DNA, 3781 bp, Homo Sapien
ctccgggtccccaggggctgcgccgggccggcctggcaagggggacgagtcagtggacactccaggaagagcggccccgcggggggcgatgaccgtgcgctgaccctgactcactccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtaccggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggagccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaaaaaaaaaaaa

SEQ ID NO: 454 - protein, 837 aa, Homo Sapien [sequence omitted]

SEQ ID NO: 455 - DNA, 1903 bp, Homo Sapien
taagatgagggcatccctcacgttcacacccctggtggcatctgccagccctgttctggggacaaggcgggctttcgtgggagccatgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaagatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccgagtgactaacgtctctgtcacacggaaatgggtacttggtggcatagagaaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctctccaaagctggtctttctgactatcattgtggtagggggaggacagatgctaaaggtggaagctgacctggagaaagagacacacggggtgactgtggcaaaggacagctggaaaagaaactctatcacttcttcattggcaaccacaaggcacccgaggccatggcactcccagaggctgtgcgcagagccaagcctctcaacctcttctggccctgcgtcctgcagcgaagtctctgctgtaagacagtagactccttcgatgaggtgctcaaaaatgctacccggggtggtggtgtctggcttgcagtctggcccagttcagagaaagttgcagagatcaggggccaaggatgtcatagccccaggttgtcctcagggtcccaatcctagggcagggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttcagttacccttgcagggggccagggagtcaagaatataccgtgttcctccagggtttaagccggccatgccttcccgagagcataaccaacttgacaggggtgcccagttaccccacaaactgaaggaaggagatccttcccccgtccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatctcgtgccg

SEQ ID NO: 456 - protein, 148 aa, Homo Sapien [sequence omitted]

SEQ ID NO: 457 - DNA, 2388 bp, Homo Sapien
cccgcgcgcccctggcactcaatccccgccatgtgggggctcctgctcgccctggccgccttcgcgccggccgtcggcccggctctgggggcgcccaggaactcggtgctgggcctcgcgcagcccgggaccaccaaggtcccaggctcgaccccggccctgcatagcagcccggcacagccgccggcggagacagctaacgggacctcagaacagcatgtccggattcgagtcatcaagaagaaaaaggtcattatgaagaagcggaagaagctaactctaactcgccccaccccactggtgactgccgggccccttgtgacccccactccagcagggaccctcgaccccgctgagaaacaagaaacaggctgtcctcctttgggtctggagtccctgcgagtttcagatagccggcttgaggcatccagcagccagtcctttggtcttggaccacaccgaggacggctcaacattcattcaggcctggaggacggcgatctatatgatggagcctggtgtgctgaggagcaggacgccgatccatggtttcaggtggacgctgggcaccccacccgcttctcgggtgttatcacacagggcaggaactctgtctggaggtatgactgggtcacatcatacaaggtccagttcagcaatgacagtcggacctggtggggaagtaggaaccacagcagtgggatggacgcagtatttcctgccaattcagacccagaaactccagtgctgaacctcctgccggagccccaggtggcccgcttcattcgcctgctgccccagacctggctccagggaggcgcgccttgcctccgggcagagatcctggcctgcccagtctcagaccccaatgacctattccttgaggcccctgcgtcgggatcctctgaccctctagactttcagcatcacaattacaaggccatgaggaagctgatgaagcaggtacaagagcaatgccccaacatcacccgcatctacagcattgggaagagctaccagggcctgaagctgtatgtgatggaaatgtcggacaagcctggggagcatgagctgggggagcctgaggtgcgctacgtggctggcatgcatgggaacgaggccctggggcgggagttgcttctgctcctgatgcagttcctgtgccatgagttcctgcgagggaacccacgggtgacccggctgctctctgagatgcgcattcacctgctgccctccatgaaccctgatggctatgagatcgcctaccaccggggttcagagctggtgggctgggccgagggccgctggaacaaccagagcatcgatcttaaccataattttgctgacctcaacacaccactgtgggaagcacaggacgatgggaaggtgccccacatcgtccccaaccatcacctgccattgcccacttactacaccctgcccaatgccaccgtggctcctgaaacgcgggcagtaatcaagtggatgaagcggatcccctttgtgctaagtgccaacctccacgggggtgagctcgtggtgtcctacccattcgacatgactcgcaccccgtgggctgcccgcgagctcacgcccacaccagatgatgctgtgtttcgctggctcagcactgtctatgctggcagtaatctggccatgcaggacaccagccgccgaccctgccacagccaggacttctccgtgcacggcaacatcatcaacggggctgactggcacacggtccccgggagcatgaatgacttcagctacctacacaccaactgctttgaggtcactgtggagctgtcctgtgacaagttccctcacgagaatgaattgccccaggagtgggagaacaacaaagacgccctcctcacctacctggagcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattgatacctgcggtttaagagccctagggcaggctggacctgtcaagacgggaaggggaagagtagagagggagggacaaagtgaggaaaaggtgctcattaaagctaccgggcaccttaaaaaaaaaaaaaaaaaaaaaaaaaaaaaaaaaaaaaa

SEQ ID NO: 458 - protein, 734 aa, Homo Sapien [sequence omitted]

SEQ ID NO: 459 - DNA, 537 bp, Homo Sapien
taaaacagctacaatattccagggccagtcacttgccatttctcataacagcgtcagagagaaagaactgactgaaacgtttgagatgaagaaagttctcctcctgatcacagccatcttggcagtggctgttggtttcccagtctctcaagaccaggaacgagaaaaaagaagtatcagtgacagcgatgaattagcttcagggttttttgtgttcccttacccatatccatttcgcccacttccaccaattccatttccaagatttccatggtttagacgtaattttcctattccaatacctgaatctgcccctacaactccccttcctagcgaaaagtaaacaagaaggataagtcacgataaacctggtcacctgaaattgaaattgagccacttccttgaagaatcaaaattcctgttaataaaagaaaaacaaatgtaattgaaatagcacacagcattctctagtcaatatctttagtgatcttctttaataaacatgaaagcaaagattttggtttcttaatttccaca

SEQ ID NO: 460 - protein, 85 aa, Homo Sapien
MKKVLLLITAILAVAVGFPVSQDQEREKRSISDSDELASGFFVFPYPYPFRPLPPIPFPRFPWFRRNFPIPIPESAPTTPLPSEK

SEQ ID NO: 461 - DNA, 1536 bp, Homo Sapien
agcaggagcaggagagggacaatggaagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcagtgcccatactccatagcatggtgcaaaaattcccaggcgtgtcatttgggatcagcactgattctgaggttctgacacactacaacatcactgggaacaccatctgcctctttcgcctggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcgcacacacacacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttata

SEQ ID NO: 462 - protein, 273 aa, Homo Sapien
MEAAPSRFMFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 463 - DNA, 764 bp, Homo Sapien
ctcgcttcttccttctggatgggggcccagggggcccaggagagtataaaggcgatgtggagggtgcccggcacaaccagacgcccagtcacaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtgaaactgggagccttaggtgggaatacccaggaagtcaccctgcagccaggcgaatacatcacaaaagtctttgtcgccttccaagctttcctccggggtatggtcatgtacaccagcaaggaccgctatttctattttgggaagcttgatggccagatctcctctgcctaccccagccaagaggggcaggtgctggtgggcatctatggccagtatcaactccttggcatcaagagcattggctttgaatggaattatccactagaggagccgaccactgagccaccagttaatctcacatactcagcaaactcacccgtgggtcgctagggtggggtatggggccatccgagctgaggccatctgtgtggtggtggctgatggtactggagtaactgagtcgggacgctgaatctgaatccaccaataaataaagcttctgcagaaaa

SEQ ID NO: 464 - protein, 178 aa, Homo Sapien
MHRPEAMLLLLTLALLGGPTWAGKMYGPGGGKYFSTTEDYDHEITGLRVSVGLLLVKSVQVKLGDSWDVKLGALGGNTQEVTLQPGEYITKVFVAFQAFLRGMVMYTSKDRYFYFGKLDGQISSAYPSQEGQVLVGIYGQYQLLGIKSIGFEWNYPLEEPTTEPPVNLTYSANSPVGR

SEQ ID NO: 465 - DNA, 3582 bp, Homo Sapien
cggacgcgtgggtccggcggcctgaggctgcaccgggcacgggtcggccgcaatccagcctgggcggagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggatcattgccactaccaagggcgagtaaggggcttccccgactcctgggtagtcctctgcacctgctctgggatgagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcaggggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccagcttctcaggactctggacattcaggtggcgctgaccggcctggaggtgtggaccgagcgggaccgcagccgcgtcacgcaggacgccaacgccacgctctgggccttcctgcagtggcgccgggggctgtgggcgcagcggccccacgactccgcgcagctgctcacgggccgcgccttccagggcgccacagtgggcctggcgcccgtcgagggcatgtgccgcgccgagagctcgggaggcgtgagcacggaccactcggagctccccatcggcgccgcagccaccatggcccatgagatcggccacagcctcggcctcagccacgaccccgacggctgctgcgtggaggctgcggccgagtccggaggctgcgtcatggctgcggccaccgggcacccgtttccgcgcgtgttcagcgcctgcagccgccgccagctgcgcgccttcttccgcaaggggggcggcgcttgcctctccaatgccccggaccccggactcccggtgccgccggcgctctgcgggaacggcttcgtggaagcgggcgaggagtgtgactgcggccctggccaggagtgccgcgacctctgctgctttgctcacaactgctcgctgcgcccgggggcccagtgcgcccacggggactgctgcgtgcgctgcctgctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtgtgccagagcaggcgctgcaggaagaatgccttccaggagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagcagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgcttgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctgcagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtccgggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaggacttaaaaaaaaaaaaaaaaaaaaaaaaaaaaaaaagaaaa

SEQ ID NO: 466 - protein, 813 aa, Homo Sapien
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQADQVQMPRSCLW

SEQ ID NO: 467 - DNA, 660 bp, Homo Sapien
cggccagggcgccgacagcccgacctcaccaggagaacatgcagctcggcactgggctcctgctggccgccgtcctgagcctgcagctggctgcagccgaagccatatggtgtcaccagtgcacgggcttcggagggtgctcccatggatccagatgcctgagggactccacccactgtgtcaccactgccacccgggtcctcagcaacaccgaggatttgcctctggtcaccaagatgtgccacataggctgccccgatatccccagcctgggcctgggcccctacgtatccatcgcttgctgccagaccagcctctgcaaccatgactgacggctgccctcctccaggcccccggacgctcagcccccacagcccccacagcctggcgccagggctcacggccgcccctccctcgagactggccagcccacctctcccggcctctgcagccaccgtccagcaccgcttgtcctagggaagtcctgcgtggagtcttgcctcaatctgctgccgtccaagcctggggcccatcgtgcctgccgccccttcaggtcccgacctccccacaataaaatgtgattggatcgtgtggtacaaaaaaaaaaaaaaaaaaaaaaaaaaaaaaaaaaaaaaaaaaaaaaaaaaaaaaaaaaaaaaa

SEQ ID NO: 468 - protein, 97 aa, Homo Sapien
MQLGTGLLLAAVLSLQLAAAEAIWCHQCTGFGGCSHGSRCLRDSTHCVTTATRVLSNTEDLPLVTKMCHIGCPDIPSLGLGPYVSIACCQTSLCNHD

SEQ ID NO: 469 - DNA, 1342 bp, Homo Sapien
catggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatccttatatatgtatgcttgttttgtgtacaggattttgttttttctttttaagtacaggttcctagtgttttactataactgtcactatgtatgtaactgacatatataaatagtcatttataaatgaccgtattataacatttgaaaaagtcttcatcaaaaaaaaaaaaaaa

SEQ ID NO: 470 - protein, 209 aa, Homo Sapien
MEPLAAYPLKCSGPRAKVFAVLLSIVLCTVTLFLLQLKFLKPKINSFYAFEVKDAKGRTVSLEKYKGKVSLVVNVASDCQLTDRNYLGLKELHKEFGPSHFSVLAFPCNQFGESEPRPSKEVESFARKNYGVTFPIFHKIKILGSEGEPAFRFLVDSSKKEPRWNFWKYLVNPEGQVVKFWRPEEPIEVIRPDIAALVRQVIIKKKEDL

SEQ ID NO: 471 - DNA, 2594 bp, Homo Sapien
gccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccgtaggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcattggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgaggg

SEQ ID NO: 472 - protein, 529 aa, Homo Sapien
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIEEDTDHNYYISRIYGPSDSASRDLWVNIDQMEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHAGLIIGILILVLIVATAILVTVYMYHHPTSAASIFFIERRPSRWPAMKFRRGSGHPAYAEVEPVGEKEGFIVSEQC

SEQ ID NO: 473 - DNA, 2870 bp, Homo Sapien
cgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcgcaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggcgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagactgatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcct

SEQ ID NO: 474 - protein, 417 aa, Homo Sapien
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 475 - DNA, 918 bp, Homo Sapien
agccaggcagcacatcacagcgggaggagctgtcccaggtggcccagctcagcaatggcaatgggggtccccagagtcattctgctctgcctctttggggctgcgctctgcctgacagggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacccggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcagtggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcaaaa

SEQ ID NO: 476 - protein, 251 aa, Homo Sapien [sequence omitted]

SEQ ID NO: 477 - DNA, 3288 bp, Homo Sapien
cccacgcgtccgggacagatgaacttaaaagagaagctttagctgccaaagattgggaaagggaaaggacaaaaaagacccctgggctacacggcgtaggtgcagggtttcctactgctgttcttttatgctgggagctgtggctgtaaccaactaggaaataacgtatgcagcagctatggctgtcagagagttgtgcttcccaagacaaaggcaagtcctgtttctttttcttttttggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcacgcgccagtatttcaggacaaagaaacagtcttaaaaatatcagaaaatacagctgaagggacagcatttagactagaaagagcacaggatccagatggaggacttaacggtatccaaaactacacgatcagccccaactcttttttccatattaacattagtggcggtgatgaaggcatgatatatccagagctagtgttggacaaagcactggatcgggaggagcagggagagctcagcttaaccctcacagcgctggatggtgggtctccatccaggtctgggacctctactgtacgcatcgttgtcttggacgtcaatgacaatgccccacagtttgcccaggctctgtatgagacccaggctccagaaaacagccccattgggttccttattgttaaggtatgggcagaagatgtagactctggagtcaacgcggaagtatcctattcattttttgatgcctcagaaaatattcgaacgacctttcaaatcaatcctttttctggggaaatctttctcagagaattgcttgattatgagttagtaaattcttacaaaataaatatacaggcaatggacggtggaggcctttctgcaagatgtagggttttagtggaagtattggacaccaatgacaatccccctgaactgatcgtatcatcattttccaactctgttgctgagaattctcctgagacgccgctggctgtttttaagattaatgacagagactctggagaaaatggaaagatggtttgctacattcaagagaatctgccattcctactaaaaccttctgtggagaatttttacatcctaattacagaaggcgcgctggacagagagatcagagccgagtacaacatcactatcaccgtcactgacttggggacacccaggctgaaaaccgagcacaacataacggtcctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaagacccgcacctgcccctcgcctccctggtctccatcaacgcggacaacggccacctgttcgccctcaggtcgctggactacgaggccctgcaggctttcgagttccgcgtgggcgccacagaccgcggctcccccgcgctgagcagagaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctcgtggtgcttgtcaaggacaatggcgagcctcctcgctcggccaccgccacgctgcacttgctcctggtggacggcttctcccagccctacctgcctctcccggaggcggccccggcccaggcccaggccgaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgaggggcgctgagaccctgtcccagagctaccagtatgaggtgtgtctgacgggaggccccgggaccagtgagttcaagttcttgaaaccagttatttcggatattcaggcacagggccctgggaggaagggtgaagaaaattccaccttccgaaatagctttggatttaatattcagtaaagtctgtttttagtttcatatacttttggtgtgttacatagccatgtttctattagtttacttttaaatctcaaatttaagttattatgcaacttcaagcattattttcaagtagtatacccctgtggttttacaatgtttcatcatttttttgcattaataacaactgggtttaatttaatgagtatttttttctaaatgatagtgttaaggttttaattctttccaactgcccaaggaattaattactattatatctcattacagaaatctgaggttttgattcatttcagagcttgcatctcatgattctaatcacttctgtctatagtgtacttgctctatttaagaaggcatatctacatttccaaactcattctaacattctatatattcgtgtttgaaaaccatgtcatttatttctacatcatgtatttaaaaagaaatatttctctactactatgctcatgacaaaatgaaacaaagcatattgtgagcaatactgaacatcaataatacccttagtttatatacttattattttatctttaagcatgctacttttacttggccaatattttcttatgttaacttttgctgatgtataaaacagactatgccttataattgaaataaaattataatctgcctgaaaatgaataaaaataaaacattttgaaatgtgaaaaaaaaaaaaaaaaaaaaaa

SEQ ID NO: 478 - protein, 800 aa, Homo Sapien
MAVRELCFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHAPVFQDKETVLKISENTAEGTAFRLERAQDPDGGLNGIQNYTISPNSFFHINISGGDEGMIYPELVLDKALDREEQGELSLTLTALDGGSPSRSGTSTVRIVVLDVNDNAPQFAQALYETQAPENSPIGFLIVKVWAEDVDSGVNAEVSYSFFDASENIRTTFQINPFSGEIFLRELLDYELVNSYKINIQAMDGGGLSARCRVLVEVLDTNDNPPELIVSSFSNSVAENSPETPLAVFKINDRDSGENGKMVCYIQENLPFLLKPSVENFYILITEGALDREIRAEYNITITVTDLGTPRLKTEHNITVLVSDVNDNAPAFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHLLLVDGFSQPYLPLPEAAPAQAQAEADLLTVYLVVALASVSSLFLLSVLLFVAVRLCRRSRAASVGRCSVPEGPFPGHLVDVRGAETLSQSYQYEVCLTGGPGTSEFKFLKPVISDIQAQGPGRKGEENSTFRNSFGFNIQ

SEQ ID NO: 479 - DNA, 1470 bp, Homo Sapien
ctcggctggatttaaggttgccgctagccgcctgggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggaggaggaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaactttctatatcgctattaaacttttttctttttttcta

SEQ ID NO: 480 - protein, 248 aa, Homo Sapien
MGPVRLGILLFLFLAVHEAWAGMLKEEDDDTERLPSKCEVCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQCETMLEEFEDIVGDWYFHHQEQPLQNFLCEGHVLPAAETACLQETWTGKEITDGEEKTEGEEEQEEEEEEEEEEGGDKMTKTGSHPKLDREDL

SEQ ID NO: 481 - DNA, 1786 bp, Homo Sapien
ggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaaaaaaaaaaaaaaaaaaaaaaaaaaaaa

SEQ ID NO: 482 - protein, 234 aa, Homo Sapien
MAASRWARKAVVLLCASDLLLLLLLLPPPGSCAAEGSPGTPDESTPPPRKKKKDIRDYNDADMARLLEQWEKDDDIEEGDLPEHKRPSAPVDFSKIDPSKPESILKMTKKGKTLMMFVTVSGSPTEKETEEITSLWQGSLFNANYDVQRFIVGSDRAIFMLRDGSYAWEIKDFLVGQDRCADVTLEGQVYPGKGGGSKEKNKTKQDKGKKKKEGDLKSRSSKEENRAGNKREDL

SEQ ID NO: 483 - DNA, 2379 bp, Homo Sapien
gttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccattcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 484 - protein, 322 aa, Homo Sapien
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 485 - DNA, 539 bp, Homo Sapien
agagttcctttttctaggtcgattaggttatacattgttgaagtatagtttcgagttagaattggtcattttattttcagtgtttcacagaaatcgaagaagacagaaatggcgcttctgtggtggatatctacagtagcaatactgttgtttacttcgacgattttgggaacatacgttgaagctggtgccgctaagtctaacgaagaagagattgtgaacaaaagcgaatttggaagatttccacgagggtcgagaaaggatgcatcggggtgccacaagccgggctaccctgtaccccctcattctcgctgccctccacctccccatgtgcagcgtcctcgtcctattctgcatgcttagtctaacaccatcaggctcgtttatcttttctgtcattgatctcaccaggagcaaatcactagtgcgtgcttctgattcacgtaacgtagtatgtaaataaatgtcagtgatattatgaattggtaaaacatttctgttatctaaataaaacagtgaagtttgtttgactaaaaaaa

SEQ ID NO: 486 - protein, 84 aa, Homo Sapien [sequence omitted]

SEQ ID NO: 487 - DNA, 843 bp, Homo Sapien
cggggacggaagcggcccctgggcccgaggggctggagccgggccggggcgatgtggagcgcgggccgcggcggggctgcctggccggtgctgttggggctgctgctggcgctgttagtgccgggcggtggtgccgccaagaccggtgcggagctcgtgacctgcgggtcggtgctgaagctgctcaatacgcaccaccgcgtgcggctgcactcgcacgacatcaaatacggatccggcagcggccagcaatcggtgaccggcgtagaggcgtcggacgacgccaatagctactggcggatccgcggcggctcggagggcgggtgcccgcgcgggtccccggtgcgctgcgggcaggcggtgaggctcacgcatgtgcttacgggcaagaacctgcacacgcaccacttcccgtcgccgctgtccaacaaccaggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaaggcatcttcatcaagcctagtgtggagccctctgcaggtcacgatgaactctgagtgtgtggatggatgggtggatggagggtggcaggtggggcgtctgcagggccactcttggcagagactttgggtttgtaggggtcctcaagtgcctttgtgattaaagaatgttggtctatgaaa

SEQ ID NO: 488 - protein, 221 aa, Homo Sapien
MWSAGRGGAAWPVLLGLLLALLVPGGGAAKTGAELVTCGSVLKLLNTHHRVRLHSHDIKYGSGSGQQSVTGVEASDDANSYWRIRGGSEGGCPRGSPVRCGQAVRLTHVLTGKNLHTHHFPSPLSNNQEVSAFGEDGEGDDLDLWTVRCSGQHWEREAAVRFQHVGTSVFLSVTGEQYGSPIRGQHEVHGMPSANTHNTWKAMEGIFIKPSVEPSAGHDEL

SEQ ID NO: 489 - DNA, 3322 bp, Homo Sapien
cagcagccgagacagcagctgagacggcagcggcagcttctcagggccggagccagttcttggaggagactctgcacagggcatggatcactgtggtgcccttttcctgtgcctgtgccttctgactttgcagaatgcaacaacagagacatgggaagaactcctgagctacatggagaatatgcaggtgtccaggggccggagctcagttttttcctctcgtcaactccaccagctggagcagatgctactgaacaccagcttcccaggctacaacctgaccttgcagacacccaccatccagtctctggccttcaagctgagctgtgacttctctggcctctcgctgaccagtgccactctgaagcgggtgccccaggcaggaggtcagcatgcccggggtcagcacgccatgcagttccccgccgagctgacccgggacgcctgcaagacccgccccagggagctgcggctcatctgtatctacttctccaacacccactttttcaaggatgaaaacaactcatctctgctgaataactacgtcctgggggcccagctgagtcatgggcacgtgaacaacctcagggatcctgtgaacatcagcttctggcacaaccaaagcctggaaggctacaccctgacctgtgtcttctggaaggagggagccaggaaacagccctgggggggctggagccctgagggctgtcgtacagagcagccctcccactctcaggtgctctgccgctgcaaccacctcacctactttgctgttctcatgcaactctccccagccctggtccctgcagagttgctggcacctcttacgtacatctccctcgtgggctgcagcatctccatcgtggcctcgctgatcacagtcctgctgcacttccatttcaggaagcagagtgactccttaacacgtatccacatgaacctgcatgcctccgtgctgctcctgaacatcgccttcctgctgagccccgcattcgcaatgtctcctgtgcccgggtcagcatgcacggctctggccgctgccctgcactacgcgctgctcagctgcctcacctggatggccatcgagggcttcaacctctacctcctcctcgggcgtgtctacaacatctacatccgcagatatgtgttcaagcttggtgtgctaggctggggggccccagccctcctggtgctgctttccctctctgtcaagagctcggtatacggaccctgcacaatccccgtcttcgacagctgggagaatggcacaggcttccagaacatgtccatatgctgggtgcggagccccgtggtgcacagtgtcctggtcatgggctacggcggcctcacgtccctcttcaacctggtggtgctggcctgggcgctgtggaccctgcgcaggctgcgggagcgggcggatgcaccaagtgtcagggcctgccatgacactgtcactgtgctgggcctcaccgtgctgctgggaaccacctgggccttggccttcttttcttttggcgtcttcctgctgccccagctgttcctcttcaccatcttaaactcgctgtacggtttcttccttttcctgtggttctgctcccagcggtgccgctcagaagcagaggccaaggcacagatagaggccttcagctcctcccaaacaacacagtagtccgggcctcctggcctggaatcctcagcctctctggccgccagtagcctgaggctacggctcctgctagagagggtggcaggcctgctgctggaccccagaggccactgtgaccgccaaggggccttttccacttccacggcctctccaggcactgaggggaaggcattgctctacctctccctgacattttgctccggggcagatccaaccttacctggggcagcaaactttgtcctggtacctgggcccagctcgccagggatgtgggcagagcaccagcctgggcatcaggaagccaagtttcaaggactgtctttgagtctgtctgtatgaccttgggcctgccacttctcacagaccctaggtatccacagctgtgacatgggggcaagcagctttgtttcagcctaacccaggagcttagtaaaaattgcataagaccagggggaagagtgtcagcgtggggtgggaattcccgcggcctccacctgcttgctaggggcaggatctcattcaggctgccctggaagcacctgcttggccctgccaccttcctccaggggagggccagatggcatcctggcttggggcgggtgggacctacccaggctctgagactttactggcctatgcctgaggcctcttttcctttaactccctaaattatgatgactccaagtccaagcccacccttcccaaagattgggaggttccgccgttcccagaggctcctcctgcggtgctcccaagacttccatagaccatctggaccagtagcccatcccgcagttttcttgggggcagaggaaaacgcttctttctcctccagctgaatcagctggatcccagtgtcctggctgtttggtgattgggcaagattgaatttgcccaggtaggcgtgagagtgtgggttttaaattcgaagctcaggccatagtttcagagaatcacccttaccccagaccttcatgagacagtgctcatgaagccagtgcgtttcccagaacgaacactaggcggcaccgttggtccacactcagaggcccttggcgccaagactgcatctagaatcgctcaaacacctgtttgcagaccccatgcaccagctggaggggccgtaactgcaggactgcgcctactgagtgacccatttcctccaggaggaaaggcaagacacgcttacacggccatttgtctcttttcccaatgcggcggtgcactttcgctcttgggggctgcaccccagacatagctggcaccagagcagggtgctcaggtggtgggtgctcagggccctgccccaggccactgggccgttttgatgacctcaaaggtcacaggcagaaaataggagcaggatttcccctggggaaaagttatcctgggacatcttctgctcttctgtacatttctagatgcaaataactccttcaccaggcagtgagtggcgtaggctctggagccaggctgcctgggctccaatgccagctctgccacttgctagctgtgagactgtggacaaaccactcagcctctgtgtgcctcagttttcctatttgtaaaatagagaccatagtggtacctattttgaagactaagtaaaagaattcaaataaagagacttggcacagagtaagtgctcagtaaaaa

SEQ ID NO: 490 - protein, 528 aa, Homo Sapien
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQAGGQHARGQHAMQFPAELTRDACKTRPRELRLICIYFSNTHFFKDENNSSLLNNYVLGAQLSHGHVNNLRDPVNISFWHNQSLEGYTLTCVFWKEGARKQPWGGWSPEGCRTEQPSHSQVLCRCNHLTYFAVLMQLSPALVPAELLAPLTYISLVGCSISIVASLITVLLHFHFRKQSDSLTRIHMNLHASVLLLNIAFLLSPAFAMSPVPGSACTALAAALHYALLSCLTWMAIEGFNLYLLLGRVYNIYIRRYVFKLGVLGWGAPALLVLLSLSVKSSVYGPCTIPVFDSWENGTGFQNMSICWVRSPVVHSVLVMGYGGLTSLFNLVVLAWALWTLRRLRERADAPSVRACHDTVTVLGLTVLLGTTWALAFFSFGVFLLPQLFLFTILNSLYGFFLFLWFCSQRCRSEAEAKAQIEAFSSSQTTQ

SEQ ID NO: 491 - DNA, 1305 bp, Homo Sapien
cttggctgcccgacaacaagctcgccacctgcgctgggcgcatccaccatccaaggcccagctgaggggcaccagacagaggatgaggagagagagtcgcacacgggctgccctgagagacatttccatggacatcctcatgctgcttctgcttttgtgtgtaatatatgggagattttcccaagatgaatactccctcaatcaagctatccggaaagaatttacaagaaatgccagaaactgcttgggtggcctgagaaacatcgctgactggtgggactggagtctgaccacacttctggatggcctgtacccgggaggcaccccgtcagcccgtgtgccgggggctcagcctggagctcttggaggaaaatgctacctaataggcagttccgtaattaggcagctaaaagtttttcctaggcatttatgcaagcctcccaggccattttcagcactcatcgaagactctattcctacatgtagtcccgaagttggaggccctgagaacccctacctgatagacccagagaaccaaaacgtgaccctgaatggtcctgggggctgtgggacaagggaggactgtgtgctcagcctgggcagaacaaggactgaagcccacacagccctgtcccgactcagggccagcatgtggattgaccgcagcaccagggctgtgtctgtgcacttcactctctataaccctccaacccaactcttcaccagcgtgtccctgagagtggagatcctccctacggggagtctcgtcccctcatccctggtggagtcattcagcatcttccgcagcgactcagccctgcagtaccacctcatgcttccccagctggtcttcctggcactcagcctgatccacctctgtgttcaactctaccgtatgatggacaagggcgtcctcagctactggcgaaagccaaggaactggctggaggtagcctctcttgtgtcattttcttttgaaaaataacaataaactgtttatatcttgaaaaaataatttaaataagaaattgattatgcactagctactgccaacattattgcagttttctccctctgtagtgttaatctcaaaacagcatttgagatcaggtatcatttagtgttgttacagttaccgtcatgtaccacacgaatttcagccaaggtggtggtcccataagatcatatggtgctaagaaatttctgtcacctaatgacatcttgattctgaccttgtatgtaggcctaggctaaatatgtctgtttgtatcttagcttttaataaagaagtttaaaaataaaaaa

SEQ ID NO: 492 - protein, 300 aa, Homo Sapien
MRRESRTRAALRDISMDILMLLLLLCVIYGRFSQDEYSLNQAIRKEFTRNARNCLGGLRNIADWWDWSLTTLLDGLYPGGTPSARVPGAQPGALGGKCYLIGSSVIRQLKVFPRHLCKPPRPFSALIEDSIPTCSPEVGGPENPYLIDPENQNVTLNGPGGCGTREDCVLSLGRTRTEAHTALSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLEVASLVSFSFEK

SEQ ID NO: 493 - DNA, 2292 bp, Homo Sapien
tctcagggcttcatacaggaaatctattgctgtgtcaagttccagagaaaagcttctgttcgtccaagttactaaccaggctaaaccacatagacgtgaaggaaggggctagaaggaagggagtgccccactgttgatggggtaagaggatcctgtactgagaagttgaccagagagggtctcaccatgcgcacagttccttctgtacctgtgtggaggaaaagtactgagtgaagggcagaaaaagagaaaacagaaatgctctgcccttggagaactgctaacctagggctactgttgattttgactatcttcttagtggccgaagcggagggtgctgctcaaccaaacaactcattaatgctgcaaactagcaaggagaatcatgctttagcttcaagcagtttatgtatggatgaaaaacagattacacagaactactcgaaagtactcgcagaagttaacacttcatggcctgtaaagatggctacaaatgctgtgctttgttgccctcctatcgcattaagaaatttgatcataataacatgggaaataatcctgagaggccagccttcctgcacaaaagcctacaggaaagaaacaaatgagaccaaggaaaccaactgtactgatgagagaataacctgggtctccagacctgatcagaattcggaccttcagattcgtccagtggccatcactcatgacgggtattacagatgcataatggtaacacctgatgggaatttccatcgtggatatcacctccaagtgttagttacacctgaactgaccctgtttcaaaacaggaatagaactgcagtatgcaaggcagttgcagggaagccagctgcgcagatctcctggatcccagagggcgattgtgccactaagcaagaatactggagcaatggcacagtgactgttaagagtacatgccactgggaggtccacaatgtgtctaccgtgacctgccacgtctcccatttgactggcaacaagagtctgtacatagagctacttcctgttccaggtgccaaaaaatcagcaaaattatatattccatatatcatccttactattattattttgaccatcgtgggattcatttggttgttgaaagtcaatggctgcagaaaatataaattgaataaaacagaatctactccagttgttgaggaggatgaaatgcagccctatgccagctacacagagaagaacaatcctctctatgatactacaaacaaggtgaaggcatctcaggcattacaaagtgaagttgacacagacctccatactttataagttgttggactctagtaccaagaaacaacaacaaacgagatacattataattactgtctgattttcttacagttctagaatgaagacttatattgaaattaggttttccaaggttcttagaagacattttaatggattctcattcatacccttgtataattggaatttttgattcttagctgctaccagctagttctctgaagaactgatgttattacaaagaaaatacatgcccatgaccaaatattcaaattgtgcaggacagtaaataatgaaaaccaaatttcctcaagaaataactgaagaaggagcaagtgtgaacagtttcttgtgtatcctttcagaatattttaatgtacatatgacatgtgtatatgcctatggtatatgtgtcaatttatgtgtccccttacatatacatgcacatatctttgtcaaggcaccagtgggaacaatacactgcattactgttctatacatatgaaaacctaataatataagtcttagagatcattttatatcatgacaagtagagctacctcattctttttaatggttatataaaattccattgtatagttatatcattatttaattaaaaacaaccctaatgatggatatttagattcttttaagttttgtttatttcttttaagttttgtttgtggtataaacaataccacatagaatgtttcttgttcatatatctctttgtttttgagtatatctgtaggataactttcttgagtggaattgtcaggtcaaagggtttgtgcattttactattgatatatatgttaaattgtgtcaaatatatatgtcaaattccctccaacattgtttaaatgtgcctttccctaaatttctattttaataactgtactattcctgcttctacagttgccactttctctttttaatcaaccagattaaatatgatgtgagattataataagaattatactatttaataaaaatggatttata

SEQ ID NO: 494 - protein, 348 aa, Homo Sapien [sequence omitted]

SEQ ID NO: 495 - DNA, 2126 bp, Homo Sapien
ccaggtgcacagcgcatcgcccgaggctgtcaccgccctgccccgcccaccccagctgtcctggacccaggggcagggagaggctggacgccaggtgcgcggacacagaagcgtctaagcacagcttcctccttgccgctccgggaagtgggcagccagcccaggaaccagtaccacctgcaccatggggctgtcccggaaggagcaggtcttcttggccctgctgggggcctcgggggtctcaggcctcacggcactcattctcctcctggtggaggccaccagcgtgctcctgcccacagacatcaagtttgggatcgtgtttgatgcgggctcctcccacacgtccctcttcctgtatcagtggccggcgaacaaggagaatggcacgggtgtggtcagccaggccctggcctgccaggtggaagggcctggaatctcctcctacacttctaatgctgcacaggctggtgagagcctgcagggctgcttggaggaggcgctggtgctgatcccagaggcccagcatcggaaaacacccacgttcctgggggccacggctggcatgaggttgctcagccggaagaacagctctcaggccagggacatctttgcagcagtcacccaggtcctgggccggtctcccgtggacttttggggtgccgagctcctggccgggcaggccgaaggtgcctttggttggatcactgtcaactacggcttggggacgctggtcaagtactccttcactggagaatggatccagcctccggaggagatgctggtgggtgccctggacatgggaggggcctccacccagatcacgttcgtgcctgggggccccatcttggacaagagcacccaggccgattttcgcctctacggctccgactacagcgtctacactcacagctacctgtgctttggacgggaccagatgctgagcaggctcctcgtggggctggtgcagagccgcccggctgccctgctccgtcacccgtgctacctcagcggctaccagaccacactggccctgggcccgctgtatgagtcaccctgtgtccacgccacgcccccgctgagcctcccccagaacctcacagttgaagggacaggcaaccctggagcctgcgtctcagccatccgggaacttttcaacttctccagctgccagggccaggaggactgcgcctttgacggggtctaccagcccccgctgcggggccagttctatgtggaggccagctaccctgggcaggaccgctggctgcgggactactgtgcctcaggcctgtacatcctcaccctcctgcacgagggctacgggttcagcgaggagacctggcccagcctcgagttccgaaagcaggcgggcggtgtggacattggctggacactgggctacatgctgaacctgaccgggatgatcccggccgatgcgccggctcagtggcgggcagagagctacggcgtctgggtggccaaagtggtgttcatggtgctggccctggtggcggtggtgggggctgccttggtccagctcttctggttgcaggactagtgggaaggcggaggtgggcccccacagagcccacaggcagctgcgtcccggatgctggaggcttcctgagccctgagcgccgtggggccttgctctgtggctctgcccacggtcaggtgacagccacctccagggcaccgtcagggtggtgctggccacagaggctgcatgacctcccctcccggcgtccctcccccaacctccttccgcaactgggcttccagggccgtaggtgcctttctgcacacaggccgccaggactcgtggtgtctccaggctgtgtgactgcagggccacatgctgcctgcaaacagggcaagaccacggaggcacaggggtcctgctcctgatggggcctcaggaggggcggagaggggtggaagggagggagctgccccacctggacccccgctctccctgctgttgtctgagcagatggatggagtccaggcctgggggcttctgctgggccagcccggcctcccacacccacttggagggtgagactgcagtgggggttgtttttattaaaagcatcatggacacagcaaaaaaaaaaaaaaaa

SEQ ID NO: 496 - protein, 458 aa, Homo Sapien
MGLSRKEQVFLALLGASGVSGLTALILLLVEATSVLLPTDIKFGIVFDAGSSHTSLFLYQWPANKENGTGVVSQALACQVEGPGISSYTSNAAQAGESLQGCLEEALVLIPEAQHRKTPTFLGATAGMRLLSRKNSSQARDIFAAVTQVLGRSPVDFWGAELLAGQAEGAFGWITVNYGLGTLVKYSFTGEWIQPPEEMLVGALDMGGASTQITFVPGGPILDKSTQADFRLYGSDYSVYTHSYLCFGRDQMLSRLLVGLVQSRPAALLRHPCYLSGYQTTLALGPLYESPCVHATPPLSLPQNLTVEGTGNPGACVSAIRELFNFSSCQGQEDCAFDGVYQPPLRGQFYVEASYPGQDRWLRDYCASGLYILTLLHEGYGFSEETWPSLEFRKQAGGVDIGWTLGYMLNLTGMIPADAPAQWRAESYGVWVAKVVFMVLALVAVVGAALVQLFWLQD

SEQ ID NO: 497 - DNA, 1820 bp, Homo Sapien
gccttataaagtagcctctgcatctgcctgcctcgggcagaggagggctaccctggggctgagagttcacctgtctcaggaaccacctgagcccacagatcctgtgggcagcggccagggcagccatggcttgggcaagtaggctgggcctgctgctggcactgctgctgcccgtggtcggtgcctccacgccaggcaccgtggtccgactcaacaaggcagcattgagctacgtgtctgaaattgggaaagcccctctccagcgggccctgcaggtcactgtccctcatttcctggactggagtggagaggcgcttcagcccaccaggatccggattctgaatgtccatgtgccccgcctccacctgaaattcattgctggtttcggagtgcgcctgctggcagcagctaattttactttcaaggtctttcgcgccccagagcccctggagctgacgctgcctgtggaactgctggctgacacccgcgtgacccagagctccatcaggacccctgtggtcagcatctctgcctgctctttattctcgggccacgccaacgagtttgatggcagtaacagcacctcccacgcgctgctggtcctggtgcagaagcacattaaagctgtcttgagtaacaagctgtgcctgagcatctccaacctggtgcagggtgtcaatgtccacctgggcaccttaattggcctcaaccccgtgggtcctgagtcccagatccgctattccatggtcagtgtgcccactgtcaccagtgactacatttccctggaagtcaatgctgttctcttcctgctgggcaaccccatcatcctgcccacggatgccaccccttttgtgttgccaaggcatgtgggtaccgagggctccatggccaccgtgggcctctcccagcagctgtttgactctgcgctcctgctgctgcagaaggccggtgccctcaacctggacatcacagggcagctgaggtcggatgacaacctgctgaacacctctgctctgggccggctcatcccggaggtggcccgccagtttcccgagcccatgcctgtggtgctcaaggtgcggctgggtgccacacctgtggccatgctccacacaaacaacgccaccctgcggctgcagcccttcgtggaggtcctggccacagcctccaactcggctttccagtccctcttctccctggatgtggtagtgaacttgagactccagctctctgtgtccaaggtgaagcttcaggggaccacgtctgtgctgggggatgtccagctcacggtggcctcctccaacgtgggcttcattgatacagatcaggtgcgcacactgatgggcaccgtttttgagaagcccctgctggaccatctcaatgctctcttggccatgggaattgccctccctggtgtggtcaacctccactatgttgcccctgagatctttgtctatgagggctacgtggtgatatccagtggactcttctaccagagctgaggcaagaccactgggaggcctgagagtgggccagctcgctgctcaggcgaatttctcatttcaagccactggggaaactgaggcaaaaccatacttagtcatcaccaacaagctggactgcttagctgggctgttttatcttccctgagtgcctgggtctccctccctcacttctgccctttcccttcctcctcctcttctcctccctcttccctcatctcccccctccttcctctgccccaccccaggggggagcagactgctcctccaggctgtatagacctgccctcttgcattaaacaacttctcttgagctgc

SEQ ID NO: 498 - protein, 458 aa, Homo Sapien [sequence omitted]

SEQ ID NO: 499 - DNA, 899 bp, Homo Sapien
ttgaaaatctactctatcagctgctgtggttgccaccattctcaggaccctcgccatgaaagcccttatgctgctcaccctgtctgttctgctctgctgggtctcagctgacattcgctgtcactcctgctacaaggtccctgtgctgggctgtgtggaccggcagtcctgccgcctggagccaggacagcaatgcctgacaacacatgcataccttggtaagatgtgggttttctccaatctgcgctgtggcacaccagaagagccctgtcaggaggccttcaaccaaaccaaccgcaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccatccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaacccaggctcccatatgtaccccatcccccatactcacctctttccattttgagtaataaatgtctgagtctggaaaaaaaaaaaaaaaaaa

SEQ ID NO: 500 - protein, 125 aa, Homo Sapien
MKALMLLTLSVLLCWVSADIRCHSCYKVPVLGCVDRQSCRLEPGQQCLTTHAYLGKMWVFSNLRCGTPEEPCQEAFNQTNRKLGLTYNTTCCNKDNCNSAGPRPTPALGLVFLTSLAGLGLWLLH

SEQ ID NO: 501 - DNA, 845 bp, Homo Sapien
ggagcctcctaatgcagtcttctgcacagtcctggggactgactgactgaatcacacctctggggctgggggctgctgacatgtgtgcctttccttggctgcttcttctcctgctgctccaggagggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagtgagcttcctggaccccagctattccctgcatatcagcaatctgagctgggaggattcagggctttaccaagctcaagtcaacctgagaacatcccagatctctaccatgcagcagtacaatctatgtgtctaccatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctgactgctccttgggaaccccagtcctgagcttggtttcttcccagcacccagagaatccttcctcagctctcttctttccaggggaaggaggtgctcaggggtgggtatccagagagccatacttctgagggaagactggctggcaataaagtcaaattaagtgaccaca

SEQ ID NO: 502 - protein, 198 aa, Homo Sapien [sequence omitted]

SEQ ID NO: 503 - DNA, 1977 bp, Homo Sapien
acgggccgcagcggcagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatca

SEQ ID NO: 504 - protein, 339 aa, Homo Sapien
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 505 - DNA, 1671 bp, Homo Sapien
gcaaaaggaagggagggaagcactccatcatctcactgggaagaacggcacgggcatacctgcagctactggggttccactgggcttgagggtcgatttttcaccttttgaaggacaagatgcattggaagatgttgctgcttctgctgttgtattacaatgctgaggcttctatgtgccacaggtggagcagggctgtgctcttccctgccgcccaccggccaaagaggtcctcatcactgccattgaacccagtcctgcagacctccctggaggaggtggagctgctctacgagttcctgctggccgaacttgagatcagccctgacctgcagatctccatcaaggacgaggagctggcctccttgcggaaggcctcagacttccgcaccgtctgcaacaacgtcatccccaagagcatcccagacatccgccggctcagcgccagcctctccagccaccctggcatcctcaagaaagaagactttgaaaggacagtgctgaccctggcctacacagcctaccgcacagccctgtcccacggccatcagaaggacatctgggcgcagtccctcgttagcctcttccaggccctgaggcacgacttgatgcgctcctcacagccgggagtacctccctgagagactggcccacaccaggacctcagagcagggaccagcacagtaatccagaaagtcttcattctctactccatttacagagaccagcaacaaaacacttaccgctgacacagagcagcagagatcaaacagtaaccccgatgctcttttctccttgtagtttcctggaagacacatctgattcatgccatcatgtgacctgggctggaagaaagggctggaatggtcattcaagacgcctccatgggcagaatggtttgcctatggcaggcagaattctgatatgcttcaacccagagcagtggccacacactcaagagtgagaacaggcgtgagccaccgtgcctggcccaggatctaaaaactttctaagtttcctccatcgttggcatcctcacagctatctccaatgtcactcaagagacatcaacagacatttaactgctgcagacttcattgctctgtcacctcaccttgaatctaacaaatcaaagtatttctgcaggtccaatggtctaaaatcaaatgcttgttaaatgactttttacaacaccccttactttcctaatccatttcaatcttattttttttattgtggtaaaaaacacatcacgtaaaatgtaccatcttaaccatttttaagcatatggtacagcagtgttaactccatgcatgttgtgaaacagacccccggaactttctcatcttgtaattctgaagttctatacccaccgaacaactcctcttttccccttccccctgcctgccccagctcttggcaccattattctgctttctgtttttgagagtctgactacttaagatacctcatacaagcgggatctggcttacatttcttgagcattgtattctggaaaagtgtttccttcctctgaaaaatgggtagagttctgaaggagaactactggtcttattgtacacttgctgtacctatttttatttaacaaatattcatctatggtataataaagatgtcatggttggaaaaaaaaaaaaaaaaaaaaaaaaa

SEQ ID NO: 506 - protein, 173 aa, Homo Sapien
MHWKMLLLLLLYYNAEASMCHRWSRAVLFPAAHRPKRSSSLPLNPVLQTSLEEVELLYEFLLAELEISPDLQISIKDEELASLRKASDFRTVCNNVIPKSIPDIRRLSASLSSHPGILKKEDFERTVLTLAYTAYRTALSHGHQKDIWAQSLVSLFQALRHDLMRSSQPGVPP

SEQ ID NO: 507 - DNA, 2148 bp, Homo Sapien
ggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaa

SEQ ID NO: 508 - protein, 362 aa, Homo Sapien
MRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 509 - DNA, 1233 bp, Homo Sapien
gggcggacgcagtgcagtaagagcagatgggcggacccaaatttcttcggcttcacgattttgccgaggtctagccctgcatccagccttgaaacagggtggggaggaggcagaaaggggagggactgcactccctctgagcgtgctagctccgactgcctgacggatcacccttccgctccaacatggctagttcctcaacgccgtgactcaagcctgttgtgccaggcagggcgcactcagcagcgcagccccacaggtggcgaaggctccgcgagagggttcccgccaggctagacagtggagtgccgcacagcgcgccttccagcctcgcagccgccaccctagcggttccgacccggcgccagcaggcctgcttggtcgatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggaggtcagttcatccaaaggcagctagagaggcagctcagcaagtatctcagaaaggctaagtcatatatgttctcaaactagcccttttttttcctcccatcttctgaaaaccactatggagatttttctccacattttatttctaaaaaattttaaacacatatcaaagctggaagaattgtatagtaaacaaactgtataccccaaactggattcttctgctaacatttttctgtgttgctatatcacatatctatccacatatgcatacctctatttatctttcgtcaagccatcttatgtttctgatgcatttcaaagtaaatagctgacatcagtaagacatctacctaaatattttattctgttttgttaaaatttacatacaaaaacatgcataatcttaagggtaccattccatgtattttgaaaagtgtacacatctgtgtaactaaacccccaataaaattgccatcacctcag

SEQ ID NO: 510 - protein, 143 aa, Homo Sapien
MRRGWKMALSGGLRCCRRVLSWVPVLVIVLVVLWSYYAYVFELCLVIYLILYHAIFVFFTWTYWKSIFTLPQQPNQKFHLSYTDKERYENEERPEVQKQMLVDMAKKLPVYTRTGSGGQFIQRQLERQLSKYLRKAKSYMFSN

SEQ ID NO: 511 - DNA, 2176 bp, Homo Sapien
cagccggggcgatggcggggctctggctggggctcgtgtggcagaagctgctgctgtggggcgcggcgagtgccctttccctggccggcgccagtctggtcctgagcctgctgcagagggtggcgagctacgcgcggaaatggcagcagatgcggcccatccccacggtggcccgcgcctacccactggtgggccacgcgctgctgatgaagccggacgggcgaggtaagggccggcgctcctcctggagcgcaacggggtccgcagccccgttcccaccctccgatcagccaggaacccgctgcttgtggcgctggccgcaggagagaggagcctgtcaccctgtggagaatgcactcccagttctagtcgttgccccttggcacccgccgacactgctagtgccccatcccaaagtgagcattttctttgtgtgtagcacaggatgcggtatttccaaacccctgccctcggtcttttcccacctcaccgctgctcagctctcaaagccctgccgtttcctcctgccttggcttgggaagccttaggaacagaagctccctgggagcacagagcggttttaaactggccaacaccttaacgcccagagccgccctcctctcgctgccactttggaaaataagagactagagattcactggacgcttcctcccggcatcacaagacttgactgctgcttcagttcccgcttgaccttcatactttagccctttaaaggatgttacataataacaattaagagacggcagggccttcaggcagacttctttggagggtgtcaaacgccttgtttattaaagagtgaattttttaattaaaatcatgttttaaaacagagatggacattttattgatggaaaaaaatcacgttaagttagaaagctctcaaaagtacctggtatttacaactccctgtcagggagggcgaactcgatctcagagttttattttcatcagggattacgttgaggtacccagaaatgagaagatttgcccaaaatggcatattttaaaattggcccagaccagaacccagtttcctctgggattatttgttagtaatcgttttacaggctgagcattaactaactccaaagcttgaaggactttttctcattttcacttgttttctctaataaaaataatgctgtaatttcaacttcacaagatgaggcctcatggaagagtgtttaccaaaatattaaaaatactttgacagaaaaaaatcaagcgaactctttgccaaccaaatatcatcatgactgatgtaacaagtaatccaacacagatatgaaaatcactggtaaaaatcatctcagttaattctaaaagcagagctaaccaccccttttgtcctaaggctttatggtattaaaaaataaactgtacaaaaatatagattttcccctatcccctacccctggaaagtaatatactgaagtctcatcatactgttttggggattccagtaattaaaatctctagtgaacaaagacctgtttcaaaacaacctgtgagctgactggactatttaaagtaattctccttgtagtcactttcagagtgaagacaatgacgaatactgtcttttacaaagggactttttattccaccaacaaattctggattttggcatcaggaaaaccactgttcaatttccaacactatatccaagttgtttgagaaattatttaaaactctttaacttagagggttttctttctcctttacttgttaaagtgactatattacagagtcactttaaggattaaatttattgcatgcaaagtttctagatcactgtctagaagtcagttagagtaagttctttagttgtcaatcaagcatttagtaaggccctgctttgtgcccagtgttgacctcaacaaagttggggatatcagaatattctaagatacagtcgttgttcccaagaatcttgtctttcacatacaagaggtgttgcgtttcattttgcggctaatgtccaaacgctggcctcagccatttcaccttgaagattgcagttggcttccaactggcctctaaactctaatctagcattttccagtccattgtgacaaagtctgccttccccagctactcccagctgttggacctgctgccttagaaccacagattggtacctcgtgcc

SEQ ID NO: 512 - protein, 178 aa, Homo Sapien
MAGLWLGLVWQKLLLWGAASALSLAGASLVLSLLQRVASYARKWQQMRPIPTVARAYPLVGHALLMKPDGRGKGRRSSWSATGSAAPFPPSDQPGTRCLWRWPQERGACHPVENALPVLVVAPWHPPTLLVPHPKVSIFFVCSTGCGISKPLPSVFSHLTAAQLSKPCRFLLPWLGKP

SEQ ID NO: 513 - DNA, 2403 bp, Homo Sapien
ggcggctggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcttgtgggatctccccgttgctcctgcccgtggactgagtggcaggccatcctacaagcacccggacacttgacatcagtggtgtcaagacaactctaagaaggttttccgtgatcctgcaagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcacggtctgcatttcggcccctgcgggacaatggaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgctggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcaccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggccttccagcgcatcaacagtgcactgcaggttgaggacaaggccatctcggactgcagaccctcacggccttcccacactttgtcctcacttgcaacaggggcttctggtctgcctgccgtttctaaagcacccagtatggatgcacagcaggagacacacaagtcccaagactgcctgggcctactggaccccttagcatctgctgcaggggtcccctctacagctcccatgtctgggaagaagcacagaccaccaggccccctgttctcctcctcagatccccttcctgccacctcttctgattcccaggactcagcccaggtcacctcgctgattcctgcccccttcccagctgcaagcatggatgcgggcatgagaagaacaaggcatggcacttctgctcctgcagctgccgcagcagcccctccccgctccacattgaaccccacgttggggtcactactggagtggatggaggcccttcacatttctgggcctcagccacagctgcagcaggtgcccagaggtcagaaccagagatcccagacctcctggaccagctcgtgccccaaatgaaatgccatctcgagcccctacagctctacgggaggcctcccggaacaaaagcggaagaggggccagcctcatcccactgccagctgaccctcagttcctcaaacacagtgagtgaggacggacctcaggctgtctcttcgggtcacacccagtgtgaaaagacggcagatacagcaccagggcagacactcgcctccaggggtggctcccccagatcccaggcctctaggccccgtatatgcaagtttcccctgctgccacgcaggcgaggggagcctttgatgctgccacctcccttagagatggggtaccgggtcactgctgaagacctggaccgggagaaggaggaggcattccagcgcatcaacagtgcactgcaggttgaggaccaggccatctaggactgcagaccctcacggccttcccacactttgtcctcacttgcaacaggggcttctggtctgcctgccgtttctaaagcacccagtatggatgcacagcaggagacacacaagtcccaagactgcctgggcctagtggcccccctgcatctgctgcacaggcctgtagtcccagctacttgggaggctgaggcaggagaacggcataaacccgggaggcagagcttgcagtgagctgagatcgcgccactgcactccagcctgggtgacagagcgagactccgtctc

SEQ ID NO: 514 - protein, 428 aa, Homo Sapien [sequence omitted]

SEQ ID NO: 515 - DNA, 2171 bp, Homo Sapien
gtcagggccagggtgagcgcccgactccgagctgtccccgctcccggcgcggcgctccgctctcagccacctcacggctgccaggagtgcgcgggagtttgccccggagcgcggggaagtttcctccgaagctgcgctcctggaacagcagcacctgcaagcgcccggcagcggcccgcgaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcatgagtacagaaaaaatccaggaacatatcaccaaccagaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccacttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaagtgatattttggacttaggcattttactttagattggaaggcattatgtgatttacaatatgagaatatagcagaaaaacca

SEQ ID NO: 516 - protein, 443 aa, Homo Sapien [sequence omitted]

SEQ ID NO: 517 - DNA, 3690 bp, Homo Sapien
ggaacttcccaggcaccctgtgtggccgcactgctccctctggcccaaccatgcctctgtccagccacctgctgcccgccttggtcctgttcctggcagggtcctcaggctgggcctgggtccccaaccactgcaggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggctggtacatggccgttggaacccaccgagggaaagaggcatccaccgcagccctgcgctcgccaaccctgcgagaggcagcctcctcttgcaagctgaggctctggtaccacgcggcctctggagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgtgctggtggtcctgagcgcccctcctggccacgccgtgaccacagccggaacagtgcacagggctccttcctggtctccgtggccgagcctggcacccctgctatactctccagccccgaattccaagcctcaggcacctccaactgctcgctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggtggtgtttgaggcagtggccgcaggcgtggcacactcctacgtggctctggatgatctgctcctccaggacgggccctgccctcagccaggttcctgtgattttgagtctggcctgtgtggctggagccacctggccgggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggccgccccaaaaaaaaaaaaaaaaaaaaaaaaaaaaaaa

SEQ ID NO: 518 - protein, 1137 aa, Homo Sapien
MPLSSHLLPALVLFLAGSSGWAWVPNHCRSPGQAVCNFVCDCRDCSDEAQCGYHGASPTLGAPFACDFEQDPCGWRDISTSGYSWLRDRAGAALEGPGPHSDHTLGTDLGWYMAVGTHRGKEASTAALRSPTLREAASSCKLRLWYHAASGDVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRAGGPERPSWPRRDHSRNSAQGSFLVSVAEPGTPAILSSPEFQASGTSNCSLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPREVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAERAWRVVFEAVAAGVAHSYVALDDLLLQDGPCPQPGSCDFESGLCGWSHLAGPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 519 - DNA, 1150 bp, Homo Sapien
gcaggggagctccgagtgtccacaggaagggaactatcagctcctggcatctgtaaggatgctgtccatgctgaggacaatgaccagactctgcttcctgttattcttctctgtggccaccagtgggtgcagtgcagcagcagcctcttctcttgagatgctctcgagggaattcgaaacctgtgccttctccttttcttccctgcctagaagctgcaaagaaatcaaggaacgctgccatagtgcaggtgatggcctgtattttctccgcaccaagaatggtgttgtctaccagaccttctgtgacatgacttctgggggtggcggctggaccctggtggccagcgtgcacgagaatgacatgcgtgggaagtgcacggtgggtgatcgctggtccagtcagcagggcaacaaagcagactacccagagggggatggcaactgggccaactacaacacctttggatctgcagaggcggccacgagcgatgactacaagaaccctggctactacgacatccaggccaaggacctgggcatctggcatgtgcccaacaagtcccccatgcagcattggagaaacagcgccctgctgaggtaccgcaccaacactggcttcctccagagactgggacataatctgtttggcatctaccagaaatacccagtgaaatacagatcagggaaatgttggaatgacaatggcccagccatacctgtggtctatgactttggtgatgctaagaagactgcatcttattactcaccgtatggtcaacgggaatttgttgcaggattcgttcagttccgggtgtttaataacgagagagcagccaacgccctttgtgctgggataaaagttactggctgtaacactgagcatcactgcatcggtggaggagggttcttcccacagggcaaaccccgtcagtgtggggacttctccgcctttgactgggatggatatggaactcacgttaagagcagctgcagtcgggagataacggaggcggctgtactcttgttctatagatgagacagagctctgcggtgtcagggcgagaacccatcttccaaccccggctatttggagacggaaaaactggaattctaacaaggaggagaggagactaaatcacatcaatttgca

SEQ ID NO: 520 - protein, 325 aa, Homo Sapien
MLSMLRTMTRLCFLLFFSVATSGCSAAAASSLEMLSREFETCAFSFSSLPRSCKEIKERCHSAGDGLYFLRTKNGVVYQTFCDMTSGGGGWTLVASVHENDMRGKCTVGDRWSSQQGNKADYPEGDGNWANYNTFGSAEAATSDDYKNPGYYDIQAKDLGIWHVPNKSPMQHWRNSALLRYRTNTGFLQRLGHNLFGIYQKYPVKYRSGKCWNDNGPAIPVVYDFGDAKKTASYYSPYGQREFVAGFVQFRVFNNERAANALCAGIKVTGCNTEHHCIGGGGFFPQGKPRQCGDFSAFDWDGYGTHVKSSCSREITEAAVLLFYR

SEQ ID NO: 521 - DNA, 2974 bp, Homo Sapien
gatcagtgtgtgagggaactgccatcatgaggtctgacaagtcagctttggtatttctgctcctgcagctcttctgtgttggctgtggattctgtgggaaagtcctggtgtggccctgtgacatgagccattggcttaatgtcaaggtcattctagaagagctcatagtgagaggccatgaggtaacagtattgactcactcaaagccttcgttaattgactacaggaagccttctgcattgaaatttgaggtggtccatatgccacaggacagaacagaagaaaatgaaatatttgttgacctagctctgaatgtcttgccaggcttatcaacctggcaatcagttataaaattaaatgatttttttgttgaaataagaggaactttaaaaatgatgtgtgagagctttatctacaatcagacgcttatgaagaagctacaggaaaccaactacgatgtaatgcttatagaccctgtgattccctgtggagacctgatggctgagttgcttgcagtcccttttgtgctcacacttagaatttctgtaggaggcaatatggagcgaagctgtgggaaacttccagctccactttcctatgtacctgtgcctatgacaggactaacagacagaatgacctttctggaaagagtaaaaaattcaatgctttcagttttgttccacttctggattcaggattacgactatcatttttgggaagagttttatagtaaggcattaggaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaatggaaaattttgtccagagttcaggggaagatggtattgtggtgttttctctggggtcactgtttcaaaatgttacagaagaaaaggctaatatcattgcttcagcccttgcccagatcccacagaaggtgttatggaggtacaaaggaaaaaaaccatccacattaggagccaatactcggctgtatgattggataccccagaatgatcttcttggtcatcccaaaaccaaagcttttatcactcatggtggaatgaatgggatctatgaagctatttaccatggggtccctatggtgggagttcccatatttggtgatcagcttgataacatagctcacatgaaggccaaaggagcagctgtagaaataaacttcaaaactatgacaagcgaagatttactgagggctttgagaacagtcattaccgattcctcttataaagagaatgctatgagattatcaagaattcaccatgatcaacctgtaaagcccctagatcgagcagtcttctggatcgagtttgtcatgcgccacaaaggagccaagcacctgcgatcagctgcccatgacctcacctggttccagcactactctatagatgtgattgggttcctgctgacctgtgtggcaactgctatattcttgttcacaaaatgttttttattttcctgtcaaaaatttaataaaactagaaagatagaaaagagggaatagatctttccaaattcaagaaagacctgatggggtaatcctgttaattccagccacatagaatttggtgaaaaccttgctattttcatattatctattctgttattttatcttagctatatagcctagaattccatgatcatgaggttgtgagtatatctcattctttcgttgtattttcctaggtgtctttactctcttctctcactttgtgacacaaggacatgaatacatctaaattttcctatttctgatatgactgttttgatgatgtcattacttctataaccttaagtgatagggtgacatgcaatatgattattcctggtgtgcgcccaaacacatggatataaagaggtaaaaaacttaaaattcacaaaattcagtaaaccacacaaatcaggtaagtgttctatgagattagctggctatgagaaacataatgatgtttctttttcaatttaaataagcctttctacatagccagcatcagtgatctcagaaaataaattgctaataatgatgacatggcattatgcttagaaaagtttgctgtatttccatagacctcatctagatgtcatggcctacatttctgccatcactcaaccaatacttttttctgttttcttgatgataaaaagacctttctcatgattgccatcaaataacaaaagaaactattttttttctcacatagagaacatgtcagtaagatattcaaggtgaacagatatttttgggattagtaactatttgaaatatgtggtgataattactgagtttataaaatttatttgatagtacacttaaagaagatttatatgtttattctttaaaaatgatgaatactcataattcttatctctataatcaaaagtataatttactgtagaaaaataaagagatgcttgttctgaaagtaagatcagtgaactgcttttcagtctcaatctttgagaattgtaaattcatcaaataattgcttacatagtaaaaatttaaggtattagaaaacctgcataacaaatagtattatatattaaatattttgatatgtaaagctctacacaaagctaaatatagtgtaataatgtttacactagtaagcaaatatgttaatcttctcatttttttactgtcatataatcttagtgatatgcctattaatagttttaaataaataaattggcttatctggctttttgaaaattttgaaattcttacagatgttgattaggtatatctacaaattaatttcaattttaaaatgatgatataaaaataaatataagtatttttcttgtgtatgtatacaataaatataaataaaattgtttactgttttgaaagtttcttaagtttta

SEQ ID NO: 522 - protein, 527 aa, Homo Sapien
MRSDKSALVFLLLQLFCVGCGFCGKVLVWPCDMSHWLNVKVILEELIVRGHEVTVLTHSKPSLIDYRKPSALKFEVVHMPQDRTEENEIFVDLALNVLPGLSTWQSVIKLNDFFVEIRGTLKMMCESFIYNQTLMKKLQETNYDVMLIDPVIPCGDLMAELLAVPFVLTLRISVGGNMERSCGKLPAPLSYVPVPMTGLTDRMTFLERVKNSMLSVLFHFWIQDYDYHFWEEFYSKALGRPTTLCETVGKAEIWLIRTYWDFEFPQPYQPNFEFVGGLHCKPAKALPKEMENFVQSSGEDGIVVFSLGSLFQNVTEEKANIIASALAQIPQKVLWRYKGKKPSTLGANTRLYDWIPQNDLLGHPKTKAFITHGGMNGIYEAIYHGVPMVGVPIFGDQLDNIAHMKAKGAAVEINFKTMTSEDLLRALRTVITDSSYKENAMRLSRIHHDQPVKPLDRAVFWIEFVMRHKGAKHLRSAAHDLTWFQHYSIDVIGFLLTCVATAIFLFTKCFLFSCQKFNKTRKIEKRE

SEQ ID NO: 523 - DNA, 2615 bp, Homo Sapien
ggctgcggggtcggcacggaagatgcacgcgaggctcctggggctctcggccctgctgcaggcggccgaacagagcgcgcgcctttacaccgtggcttactacttcaccacaggacggcttctgtgggggtggctggcccttgctgtcctcctgcccgggttcttggtccaggccctgagctacctgtggttccgagcagacgggcatccagggcattgctccttggtgatgctgcacctcctacagcttggtgtttggaagcggcactgggacgctgcactgaccagtctgcagaaggaactggaggctccccaccgaggctggctgcagctgcaggaggccgacctgtcggcccttcgactcttggaggccctgctgcagactgggccccacctgctgcttcagacatatgtttttctagcctcagacttcacagatattgtgccaggggtgagcaccctgttttcctggtcctcactctcctgggcactggtgtcctacactcgcttcatgggcttcatgaagccaggccacctggccatgccatgggccgccctcttctgccagcagctctggaggatgggcatgttgggaacccgcgtgctgagtctggttctgttctacaaagcctaccacttttgggtttttgtggttgcaggtgcccactggctggtgatgacattctggcttgtcgcccagcagagtgacatcatcgacagcacctgccactggaggctgttcaacctgctcgtgggggccgtgtacatcctctgctacctcagcttctgggacagcccttctagaaataggatggtcacgttctacatggtcatgctgttggagaacatcatcctgttgctgttggccaccgactttctccagggggcatcgtggaccagcctgcagaccatagctggggtcctgtctggatttctgattggcagtgtctcactggtaatttattacagcctgctgcatccaaaatccacagacatctggcagggctgcctaaggaagtcctgtggcattgcaggaggtgataaaacagagagaagagattctccccgggccacagatctagctgggaagagaaccgagagctcaggctcatgccaaggggcaagttatgaaccaaccattttagggaagccccctacccctgagcaggtccccccagaggctgggctggggacccaggttgctgtggaggactctttcctcagtcatcaccactggctgtgggtgaaacttgccctaaaaacaggaaatgtgtctaagatcaatgccgcctttggagataacagtcctgcctattgtccacctgcatgggggttgagtcaacaggactacctgcagagaaaggccttgtctgcccagcaagagctcccatcctcatcccgtgacccctcaaccttagagaacagctctgcgtttgaaggtgtccctaaagcagaggccgacccattggaaacctcaagttacgtatcttttgccagcgatcagcaggatgaagcacctacccagaacccagcagccacgcagggggagggcaccccaaaggaaggagctgacgctgtttctgggacacaggggaaggggacaggtgggcagcagagaggaggggaaggacagcagagttccacgttgtacttcagcgccactgcagaagtggccacatcctcacaacaagaaggcagcccagctactctgcaaacggcccactctggaaggaggctgggaaagagcagccctgcccagcctgcatcgccccacccagtgggcttggcgcccttccccgacaccatggccgacattagccccatcctaggcacaggcccatgtagaggcttctgccccagtgcaggcttccctggaagaaccctcagtatctcagagctagaggagccgctggagcccaaaagggagctaagtcaccatgcagctgttggtgtgtgggtgtcattgccacagctgaggactgcccatgagccctgcctcacgtccacccctaagtctgagtctatccaaacggactgcagctgcagggaacagatgaagcaagagccgagttttttcatctgaccacagtcatggtgggataagacaacaggctgacaaaccaagctggccatttggtaccgtgagaaaggaaatcccacttctgacacctgtgtccttgggcacatcactgtcacctctgaatctccatctgcatccctgaaaaatgaagaaacagggctggatgattttgcaggtccaatgcaaacatcacagaccccacccatgcataggagagactctaacatactttagaggaggagaaagagattccagtcaaaattgtctgctaccttttatgagctgtaggttcccttattttatctttttgctgtggcttctaggaaacacaaaggtaaaacccagattcctattttatttgaggttcttgttacaattagctttgcctcacatttagcggttatgaatctcattttaatatattctaactgtattatgttatgaaatctcttggtaagataatttgcatgctttctgggagtaggtaaggcctgtgtgcttgtaataactaacataactgaaagtgcaaatgtca

SEQ ID NO: 524 - protein, 686 aa, Homo Sapien
MHARLLGLSALLQAAEQSARLYTVAYYFTTGRLLWGWLALAVLLPGFLVQALSYLWFRADGHPGHCSLVMLHLLQLGVWKRHWDAALTSLQKELEAPHRGWLQLQEADLSALRLLEALLQTGPHLLLQTYVFLASDFTDIVPGVSTLFSWSSLSWALVSYTRFMGFMKPGHLAMPWAALFCQQLWRMGMLGTRVLSLVLFYKAYHFWVFVVAGAHWLVMTFWLVAQQSDIIDSTCHWRLFNLLVGAVYILCYLSFWDSPSRNRMVTFYMVMLLENIILLLLATDFLQGASWTSLQTIAGVLSGFLIGSVSLVIYYSLLHPKSTDIWQGCLRKSCGIAGGDKTERRDSPRATDLAGKRTESSGSCQGASYEPTILGKPPTPEQVPPEAGLGTQVAVEDSFLSHHHWLWVKLALKTGNVSKINAAFGDNSPAYCPPAWGLSQQDYLQRKALSAQQELPSSSRDPSTLENSSAFEGVPKAEADPLETSSYVSFASDQQDEAPTQNPAATQGEGTPKEGADAVSGTQGKGTGGQQRGGEGQQSSTLYFSATAEVATSSQQEGSPATLQTAHSGRRLGKSSPAQPASPHPVGLAPFPDTMADISPILGTGPCRGFCPSAGFPGRTLSISELEEPLEPKRELSHHAAVGVWVSLPQLRTAHEPCLTSTPKSESIQTDCSCREQMKQEPSFFI

SEQ ID NO: 525 - protein, 4440 aa, Homo Sapien
AGTGCCCTCTGTCATTTAATCTCCACGGAGTCCTGAAGGTGCTTCCCAGGTTTGTCCCCATCACACAGATGAGGCAATCGTTCTGTTAAGACTGTCCTTGGGTCATTATGTCAGCAATGAAATCGGTGCTGCCATTACTAAACCCTTACTGTGTGCTGGCATTTGTGTATGCATGCATGTGTGTGCGTGCACACGTGTGTGTTTGCGTGTACATGTGCATGTGTGTGTTGTGTGCCTGTGTGTGCACATGTAGAAAGAAAGTGATGTGTGGGAATGGAGAATTCCAACCCAGGAGGAGACTGTGCCTGGGGCTGCCACGAGAAGTGGTGACACTTCGAGAAACGGGTTCCAAATGCACGTTGCCTTCCAGTTCTCTGTGTGACCTTGGGCAAGTCACTTCAGCTCCCTGAGCTTTGTTTTTAAAAATATTTTTTAAATGTATAAAACCATGGACCATTACATATGAAGAGAAATGTGTGTGCAAACATTCAGTTAATAATCACAAGGTGGAGGAGTGCCTGCTCAGACCCAGAGCTGACACAGGGAACTCTCCCAGAAGGCTGCAGGGCTTCCCTCCCAACCCTCCAACGGCCCACTTGCTGAGCCCGTGCTTATCTGTTCAGTGGAAATGCCATGTGCCACGTTCCTCAGAAGTAAAGCCACTAGGTAAGTGTGACACTCTGTGCCCAGCTTGGTGCAAAGCCCCTTGTGTGTGCTATCTTATTGACCTCCCAAATAGCATGGTAAGGTCAGTACTGTCACTTCCCCCACTTTGAAGATGAGGAGAGCACAAATTCTAGATGGAAATGGAGGTCACGCAGTGGAAATAGGATCCAGACAGATTAATCCAATCTCAAGCCTGAATTCTTCCATTCCACGCTACGCTTGAAGCTCAATCTCTCTTCCTGGTTGATTCTCCCCACTTCCCCACCCCCAGATATATCCCATCGCTGCTTGGTGGACAGTAGCCATGACTGGGTTTTGGTAAAGGTTGCTGAATAATCAGGCTGCTGGTTAGTTTTTACATTTCACCTTTCCCAGTGAAATGGGGCCCCATGAAAAAGGCAGCTCAAGTTGTAAATTACTCAAAGGAAGGACAGAAAGGTCTTCTGTTTGCACCTACCCTAAGGATTTGGGGTAGACACTGGGAATTTACTAATTATGAATTCCAGTGCTTTCCTTGCTGAAAGAGAGGCGTGGAATCAACGCTGAGTGAAGGCATCAAGTTTAAGCTGCTAATTACTTCCTGATCATGCAGAATAAAAGCTACGTCCCTTGAAATACACCAGGCAGCTAAACATAATCTTTGCGTTTCCGTAGTGTTGGTTAAGGAATCCAGATGTTACTGCAATAACCACTCCATAAACAAAAGGAACACCCAGCTGTGAGAACTGGCTTCTCAGCATTCGTCCCAGCAGAGGCTCTTCCGGGGCCAGCCCTGGAAGAACCCATCAGGGTTCTGATGGTTGCCCTGTTTCAGCACAGCCCTTATTGGCAGGCAGACGGCTACGGGCACAGCCACAGGCTGAAGGTGAGTCCAGCACACAACTTTCTGACAGTGAACAGGAGTAAACATGGGACCCACCCGAAACCTTTGTCTGTTGACTTCTTAGCAAATGGAGGCAGCTCTAGGCTCTGGAGAGTTCGGGTATAGGAGACCATGACTTGAGCAGACTGATATAAGTGGAATGCAAACATATTTAGATGGCACAACTTAATTTAGATTTATCAGTGCTAATATAGAAAAAGCTAGTATTTATTGGGGCTTATTAGATTTTTAGTCTGAATCCTCACAACTTACGAGGGGGTTCGTTTTACAGACTATGATCTTGCATGATTTCCCCAAAGATGCTCATTAAGTATATGGTGAAAGTAGAATTTGAATACAGAAGACCTGGTTCTGCTACTTTCTGTGTTTCTATTTGGTTCAAACCAGCCTTTCTTCTTTCAAAACAACTTCAGTGCAATTCATGGTTTTGGAAAATAAACTTGATTTTGAGATTCAGACAATAAGTGCATTTTTAATGTTTATTCTTTTATCTTGAAAAACTGATATATTTATGAAATGATATGTGCTCACTCAGTGTCAACACTTCAAACAACACAGACAGTACAATGACAAATTGGAGATCAGCTCTAATCTCGGCCCCCAATTTAATGCATTGCTGAATATTCTTCTGAACATAGTCCATCCCACACTGTCCCATGACACAAGACGCTCCAAGGGGCTGAAGATAGAGGGACTTCTGCAGTCAAGAGAGCTGGGAAACTCTTGGACAGTCACAATGTGCATTTGGGTATTAAAGGCTCTGCAAAGTTCTGCACCAAATAAACCCTTGGATTGGCTTGATCCAATGCCATGTTTCCAAAACCTACTTGCCCGTGGGACACCTTAGTCCATAACACAGGTTGGCATTTCTTCTAGAGAGTGTGCTGTGAAAAACACTGGTCTCACAGCACCGTGCATTCATCCAGCAGGTATTTACCAAGCAGGGACTTTGGGCCAGGTCCGTGCTAGGCTCTGCAGGTGGACCAGCCAGCCCTGACCTCCATGGTGTCTCTTCTCATGGGAGAGGCTGCACAGCAGTCATTGAGAAAACGAAGAAACACACAGGTACTTTCAGATGCTGATAATGACTACCATGTGCTAAAAGAGCTCCAGGTGTTGTCTGTTTTGAGACAATCTTCTCGACAATGAGATAGAATGAACCATGCAAACTTTGGGGGCTACGATGGTTTTAGGAAAGAGCTAGAGTGAAAAATCCTTTGACATATATACATACAAATAAAGATACATGTGTATAATTTTATGTAATTGACATCACATTATATGCTGGCACCTGCCTTTTTTGCTTAATGAAAATGTCAAAGGTAATATTACCAATCAATCAATATATTTCACCATCGTGTTTAATTTCTGCAGAGCACTTATTCAAGCACATACTGCATTTTTCTTAGTCACTCACTGGTGGGAATAGAAAGTTTTCTCAGGCATGCATTTTTCCCACTTCTGAAATGATCTCCTTAGAATAAATTCCCCAAATTGTATTGCTGGGTTCAAAGGCATGAACATTTTACATTTTTATACAATAATGTCAAACTACCTTCCGGAAATGATGCTCACTTTACTTTCCCTCCAAGACTGTGTGAAAATGCCCATTTTCCTAAATGCTTACTATGACTGGTTTCCAACTACATTTTAATTCTTGTTCAATCTGATAGGCAAAAAATGATATTTAATTTTTATTTGATTGATAATGACCTTGAACGTGCCCATTAGCCTTTTGCATGTATTCTTTTATGAAACATCTGTTCCTATCCTTCGTCAATGTTCCTCTTCATATGTTAACTTTTCTTATTGATTTGTTAGAGCACTTTGTATATTGTGAATATTAGCTTTTGTGATCAGAATTATGGAATTGTTGTTGTCTTTAGTTTTGCTTATCAAGTTTAAAGCCATTCAGAGATGTTGTAAATGTGTATGTTGTTAAATTTATGTCTTATTTTGTGTTTTCTGATGCTCATATGTTTAGAATGGTCAAGCAATCCCAACTTATGATTACATAAATATTCTCCCATATTTGCTCTTAGCATTTTTTTTCTTTTCATGTAACCCTTTGTTCTTTCAGGAATTTACTTTGCGGTAAGAAATGGGCTGGCTTCCAGTTTTATGTTTCCCAAATGGTGATTCAGCTGTTCCATTTCCATATTCTCCCTTATTAGAAATGACCACTATATTATGTTCTAAAATATCTGCGTACTTGTGTCCCTTCCTATAATCTCAGTTCATCTCTTTGAGCTATCTTTTGATTCCTTTTTCAAACCACACTGCTTTACTGAACTGTCATCATCTTATACATTTTTAATACTCAGCAAGACAAGTTTCTCAATGCCACTCTTTTTCAGAGTTTTTCTGGTGGTTGTAAGATGTTTATTCTTCTGGATAAACTTTAGAATCACTCTTTTTGTCCAAGGTAAAATATATCCCACATTGAGATCATACTGAATATACAGACTAATTCAGGAAAAAATGTATGTCTTTATTGCATTGAGTCTTCTTATCCAATAAAAAAGATATGAATTTCCATGTATTGAAATCTTCACTGAGACTTATTTTTGGCTTTTCACATGTCCTGCAAATGTATTGTTAAATTTATTTTTAGGTATTTTAGGGGAAATGATTTTCTAAAGTTTGTATTTTCTAGCTTGTTATAATTTACATATGAGATAGTCATTGTTGTATATTATTTATAACTGATCATATTACTGTATTTGTATTGTTTTAATAGTTTTTCTATTATTTTGGGTTTTCCTGGAATACAACCTTATTATCTACAAATTATGATTGTTTTGCCTTTTCCAATGTTCATAACTGTTTTTATATTCTTGTCTGATTGCTTTGTTCAGCACTTCTAGAATAAAGTCATGCAATACTAATGA

SEQ ID NO: 526 - protein, 100 aa, Homo Sapien
MSAMKSVLPLLNPYCVLAFVYACMCVRAHVCVCVYMCMCVLCACVCTCRKKVMCGNGEFQPRRRLCLGLPREVVTLRETGSKCTLPSSSLCDLGQVTSAP

SEQ ID NO: 527 - DNA, 957 bp, Homo Sapien
gtgagacttctttcttcattgtggctagctttgaaaagaccctctgaacttcctaaagatatcaagatgatatcaccagacttgccctttttgacaattgtcttgatcatagttagttggacaacttgtggagcactagccatacttctttcttatctttactatgtgtttaaggttgttcatctgcaagccagcttaacaacttttaagaatagccagcctgtgaatcccaaacactctagaagaagtgaaaagaaatccaatcatcataaagactcctcaatacaccatcttcgtttatctgccaacgatgctgaagatagccttcgcatgcacagtactgtgattaacttactaacatggattgtattactcagcatgccttctctaatttattggctaaagaatcttaggtattattttaaacttaatcctgatccatgtaaacctttggcatttatccttattccgactatggcaattcttggaaatacttacactgtttcaataaaatcaagtaaattgttgaagactacttcacaatttccacttcctctggctgttggtgtgattgcttttgggtcagcacatttatataggcttccatgctttgtcttcattcctcttttactccatgcattatgcaactttatgtaagattggacttaaggaatgatgaagataatttatgtgtttagggccagtgataagagggaacacacagatccatcagtatggacagcaagatcctttggagaagacaagtctatttttacaatattgaaaataggaaattagttttgtaatgtttgagggaagtagttgaagcatggttttgttttgtggtgtggaatccatgtactaatcatttttgaaaaattcatgaagggatatatggtgatcactatcattgaggactcctgtgcatataaaatagtctgttttatcaactgtaaa

SEQ ID NO: 528 - protein, 196 aa, Homo Sapien
MISPDLPFLTIVLIIVSWTTCGALAILLSYLYYVFKVVHLQASLTTFKNSQPVNPKHSRRSEKKSNHHKDSSIHHLRLSANDAEDSLRMHSTVINLLTWIVLLSMPSLIYWLKNLRYYFKLNPDPCKPLAFILIPTMAILGNTYTVSIKSSKLLKTTSQFPLPLAVGVIAFGSAHLYRLPCFVFIPLLLHALCNFM

SEQ ID NO: 529 - DNA, 1997 bp, Homo Sapien
gcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggacgtcttaaatgattctttgtgtaccttttctgtcatattcagaaaccgttctgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattatca

SEQ ID NO: 530 - protein, 400 aa, Homo Sapien
MAANYSSTSTRREHVKVKTSSQPGFLERLSETSGGMFVGLMAFLLSFYLIFTNEGRALKTATSLAEGLSLVVSPDSIHSVAPENEGRLVHIIGALRTSKLLSDPNYGVHLPAVKLRRHVEMYQWVETEESREYTEDGQVKKETRYSYNTEWRSEIINSKNFDREIGHKNPSAMAVESFMATAPFVQIGRFFLSSGLIDKVDNFKSLSLSKLEDPHVDIIRRGDFFYHSENPKYPEVGDLRVSFSYAGLSGDDPDLGPAHVVTVIARQRGDQLVPFSTKSGDTLLLLHHGDFSAEEVFHRELRSNSMKTWGLRAAGWMAMFMGLNLMTRILYTLVDWFPVFRDLVNIGLKAFAFCVATSLTLLTVAAGWLFYRPLWALLIAGLALVPILVARTRVPAKKLE

SEQ ID NO: 531 - DNA, 539 bp, Homo Sapien
aaaaaaaaaaaaaaaaagaagctcttatgccaggaacctggaatggagaccaaatatatattggttatatcatagtatcacagggttactttggcatttgggaaacttgagagaaatgggcaataactgttactttaaaagcttgggtgctgtgattctgccttcagcctcagccacttttgtggtgctttgcgtggcatcagtacctccactgattcttctgtctttcctctctctcttccccccctctttcccttctgtttttctcagatctaagggttataatggaggggcaaactgcctggctatttcagataagacttcactgagtgactgttcagcccatgatttaccctgcagtttaacaggctcaggaattaggtcgcatcagttgagcgcgggtcacttaggcctataatcatcatcagacggcaattaaaggaccatttctgcctttttcactattacatcccccgcctgtagcccagcctgccatacagtagatactcaataaatatttgctgaatgataaccaataa

SEQ ID NO: 532 - protein, 100 aa, Homo Sapien
MGNNCYFKSLGAVILPSASATFVVLCVASVPPLILLSFLSLFPPSFPSVFLRSKGYNGGANCLAISDKTSLSDCSAHDLPCSLTGSGIRSHQLSAGHLGL

SEQ ID NO: 533 - DNA, 2048 bp, Homo Sapien
cggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagacgtggggtctgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgggtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccatctgaggggtggcctggccttcggggtccccacgctcctttgcgaagtccactgtgggtgccatcatggtctccgggacctgggccagcgggaacgtgggggcactgggtgtgctgatataaagtcggcattactcaaaaaaaaaaaaaaaaaaaaaaaaaaaaaaaaaaaaaaaa

SEQ ID NO: 534 - protein, 189 aa, Homo Sapien
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSDVGSAGKEDPPRQGRPPIPAPP

SEQ ID NO: 535 - DNA, 1106 bp, Homo Sapien
tggatctgcgggaatgtgggctggagaggtcctgccgtggtaccagcctccagcctgcccccaggactgcccctgacccaggcgcgcccgctgctcggtggcaggagggccggcggagcgccatggcctgcatcctgaagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacagtacagagtgaccatgcagtgttgattgatcgaacagcaaccaccacatacatgtcctgccccaccacaaaaggaaggaaggaataaaagaaagaaagaaagaaacaaacaaacaaacaaacaaaactaagcaagacaaaacaaatacccatgtcagtggttcaaagattaagattgtggctttgtgtaaagttctttccctttgtagacttgctgcataattattcaggtatgatggttacagtttttaaaaaggaagggaaattgtggtatgtggtatgtaaatatttttaaatgttgtctctctgttttgatcagtttttgttttattcaatttgtctttattaaatcttatcaaagca

SEQ ID NO: 536 - protein, 210 aa, Homo Sapien
MACILKRKSVIAVSFIAAFLFLLVVRLVNEVNFPLLLNCFGQPGTKWIPFSYTYRRPLRTHYGYINVKTQEPLQLDCDLCAIVSNSGQMVGQKVGNEIDRSSCIWRMNNAPTKGYEEDVGRMTMIRVVSHTSVPLLLKNPDYFFKEANTTIYVIWGPFRNMRKDGNGIVYNMLKKTVGIYPNAQIYVTTEKRMSYCDGVFKKETGKDSTE

SEQ ID NO: 537 - DNA, 1333 bp, Homo Sapien
gttttattgacaatacatgcatcatatcttttgactttgaaggatatctcatgtcaaaggaatcaagttatgatttatagaggattcagctggaataccttgtgggtgctggctgagggtggcaaaacgcctaccgagacatgaaggttttagccactagttttgtccttgggagcctggggttggccttctacctgcctttggtggtgactacacctaaaacactggccatccctgagaagctgcaagaagctgtggggaaagttatcatcaatgccacaacctgtactgtcacctgtggccttggctataaggaggagaccgtctgtgaggtgggccctgatggagtgagaaggaaatgtcagactcagcgcttagaatgtctgaccaactggatctgtgggatgctccatttcaccattctcattggcaaggaatttgagcttagctgtctgagttcagacatcttggagtttggacaggaagctttccggttcacctggagacttgctcgaggtgtcatctccactgacgatgaggtcttcaaaccctttcaagccaactcccactttgtgaagtttaaatatgctcaggagtatgactctgggacatatcgctgtgatgtgcagctggtaaaaaacttgagacttgtcaagaggctctattttgggttgagggtccttcctcctaacttggtgaatctgaatttccatcagtcacttactgaggatcagaagttaatagatgagggattggaagttaatctggacagctactccaagcctcaccacccaaagtggaaaaagaaggtggcgtcagccttgggaataggaattgccattggagtggttggtggcgtgttggtgaggattgtcctctgtgcgctaagggggggcctgcagcagtgacagcttcaagaacttaacagccttgctcctgaagaactggctgcccaggaagccaagctagctttttaggggagtgttccagctgctggtagtggatcagcttagagggaacactcccacagccaaaagaatgagtgggagaaatggaggggacaatctcctgggagctatgcgcagtaacctaacttccttatgtcccatggatctcttcctgatcttccctgcccattgggtacccaggaaactgcaagcattgcctgtgttcctgggaagagttctaagaagcttgcattcattttctaccctttatgacttggatgcctccccacctccatttcccctcttctgagctgtgtattcatgtagagggatgtattcagcctttttagtgaacattttttttcaataaaagtaattcacagtaa

SEQ ID NO: 538 - protein, 255 aa, Homo Sapien
MKVLATSFVLGSLGLAFYLPLVVTTPKTLAIPEKLQEAVGKVIINATTCTVTCGLGYKEETVCEVGPDGVRRKCQTQRLECLTNWICGMLHFTILIGKEFELSCLSSDILEFGQEAFRFTWRLARGVISTDDEVFKPFQANSHFVKFKYAQEYDSGTYRCDVQLVKNLRLVKRLYFGLRVLPPNLVNLNFHQSLTEDQKLIDEGLEVNLDSYSKPHHPKWKKKVASALGIGIAIGVVGGVLVRIVLCALRGGLQQ

SEQ ID NO: 539 - DNA, 647 bp, Homo Sapien
gcgctcatcactggctggggacagagccgggcaccaaggagcgacaggatcccgaagagagagagagaaggcagcgagggaaggaggaccccggcaggcagcagcatgaaattcagcccagcgcactacctgctgcctctcctgcctgcgctggtcctcagcaccagacaggactatgaagagctagaaaagcagctgaaagaagtctttaaggagcgaagcaccattcttcgtcagctgacaaagacatcaagagaacttgatggaattaaagtcaatcttcagtccttaaaaaacgatgagcagtctgccaaaactgatgttcagaaacttctggaattaggacagaaacaaagagaagaaatgaagtctcttcaggaggccctgcaaaatcagcttaaggagacatcagagaaagcagaaaaacaccaggctactattaattttttaaagactgaagttgaaagaaagagcaaaatgatccgagacctccagaatgaggattcaaggaagagaccaagagatctccagtggaagatagtctccatgaggaccatgtcaatatacttattgatgtatctctagtacctagaatagtggagatttatattagatacaaaataaatatgtgtggaattaattaataa

SEQ ID NO: 540 - protein, 159 aa, Homo Sapien
MKFSPAHYLLPLLPALVLSTRQDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEDSRKRPRDLQWKIVSMRTMSIYLLMYL

SEQ ID NO: 541 - DNA, 906 bp, Homo Sapien
ctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttaaaaaaaaaaaaaaaaaaaaaaaaaaaaaaaaaaaaaaaaaaaaaaaaaaaaaaaaaaaaaaaaaaa

SEQ ID NO: 542 - protein, 178 aa, Homo Sapien
MSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSGKCRQLSRLCRNRCR

SEQ ID NO: 543 - DNA, 1024 bp, Homo Sapien
cggctcgaggtgagaaggaaactgcaagagtggggcagagaaccagagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacagacaccagaaccatctttgtcgccatcttcagctgcatctccatccttctcctcttcctctcagtcttcatcatctacagatgcagccagcacggttcatcatctgaggaatccaccaagagaaccagccattccaaacttccggagcargaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagtttctcgtctta

SEQ ID NO: 544 - protein, 236 aa, Homo Sapien
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTDTRTIFVAIFSCISILLLFLSVFIIYRCSQHGSSSEESTKRTSHSKLPEQEAAEADLSNMERVSLSTADPQGVTYAELSTSALSEAASDTTQEPPGSHEYAALKV

SEQ ID NO: 545 - DNA, 1535 bp, Homo Sapien
ggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaa

SEQ ID NO: 546 - protein, 458 aa, Homo Sapien
MMLIPMASVMAVTEPKWVSVWSRFLWVTLLSMVLGSLLALLLPLGAVEEQCLAVLKGLYLLRSKPDRAQHAATKCTSPSTELSITSRGATLLVAKTKASPAGKLEARAALNQALEMKRQGKREKAQKLFMHALKMDPDFVDALTEFGIFSEEDKDIIQADYLYTRALTISPYHEKALVNRDRTLPLVEEIDQRYFSIIDSKVKKVMSIPKGNSALRRVMEETYYHHIYHTVAIEGNTLTLSEIRHILETRYAVPGKSLEEQNEVIGMHAAMKYINTTLVSRIGSVTISDVLEIHRRVLGYVDPVEAGRFRTTQVLVGHHIPPHPQDVEKQMQEFVQWLNSEEAMNLHPVEFAALAHYKLVYIHPFIDGNGRTSRLLMNLILMQAGYPPITIRKEQRSDYYHVLEAANEGDVRPFIRFIAKCTETTLDTLLFATTEYSVALPEAQPNHSGFKETLPVKP

SEQ ID NO: 547 - DNA, 1863 bp, Homo Sapien
cctctgtctgtgctcccatcccagggagtataggtggagcctccagagcccatggacagggcatgctggggctgggccagccccagcggtgtctctaaggcacccctgggatccccactgagctggcctacttcagacagccagggcccacccctctggcccccttagtgtccagctcgtggccccttggcatttccacaagacgccaagatggagattcccatggggacccagggctgcttctcaaagagcctcctgctctcagcctcaatcctggtcctctggatgctccaaggctcccaggcagctctctacatccagaagattccagagcagcctcaaaagaaccaggaccttctcctgtcagtccagggtgtcccagacaccttccaggacttcaactggtacctgggggaggagacgtacggaggcacgaggctatttacctacatccctgggatacaacggcctcagagggatggcagtgccatgggacagcgagacatcgtgggcttccccaatggttccatgctgctgcgccgcgcccagcctacagacagtggcacctaccaagtagccattaccatcaactctgaatggactatgaaggccaagactgaggtccaggtagctgaaaagaataaggagctgcccagtacacacctgcccaccaacgctgggatcctggcggccaccatcattggatctcttgctgccggggcccttctcatcagctgcattgcctatctcctggtgacaaggaactggaggggccagagccacagactgcctgctccgaggggccagggatctctgtccatcttgtgctcggctgtatccccagtgccttcagtgacgcccagcacatggatggcgaccacagagaagccagaattgggccctgctcatgatgctggtgacaacaacatctatgaagtgatgccctctccagtcctcctggtgtcccccatcagtgacacaaggtccataaacccagcccggcccctgcccacacccccacacctgcaggcggagccagagaaccaccagtaccagcaggacctgctaaaccccgaccctgccccctactgccagctggtgccaacttcctgatgggtcctgggccaggccagccagggagaagacaaggccccagccctcctctgggagcctcacacctgagaccagcaggacaaggccattgggggctgtggggccgatgaggtggactcagccaaagactcagcagcacatggggcaggtgtcctggcagggggacaggagactgtaacaggcccaggtccttgtgcagcccctgaatgcacgcccgccttcggtctgttccttcaagcaagctggcctgggccatgtgcctgtgaaaggcaggctctggcccctttccatgccaaagtcccccaagatctggatatctggggacaagatggtggcctcaggcctgcctcccaggcagttggctgggctcccaactgtctgtcctcaatgccctaccccaactccactagtgaccctcagagtcttctccccttaggacaaggcagacaccccaccatgcgggcctcaggtggcagagaggcccagcctcacaggcctgtggccccacacaccagtcccagcaaggtgaccacggctgctggaccccttccctgttcaggcaggcccagcccctctcagaacctgctgccagctgctggtcttggcccccaccctgaatcttactgagtccctctgggcagcagctcccttctccaccccaccccagcacccgtcccaaatgtggcctcagcttgtcctccccttccccaaactatgcattcattcagcaataaatgagcctttgctgca

SEQ ID NO: 548 - protein, 300 aa, Homo Sapien
MEIPMGTQGCFSKSLLLSASILVLWMLQGSQAALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAEKNKELPSTHLPTNAGILAATIIGSLAAGALLISCIAYLLVTRNWRGQSHRLPAPRGQGSLSILCSAVSPVPSVTPSTWMATTEKPELGPAHDAGDNNIYEVMPSPVLLVSPISDTRSINPARPLPTPPHLQAEPENHQYQQDLLNPDPAPYCQLVPTS

SEQ ID NO: 549 - DNA, 2213 bp, Homo Sapien
gccactcacaccatctgctaatgggacagctcactcttccctccaaaccatggccttggctcaagagcttccttgtttctggaatgttctttcctccagctccaggtgttgaaattctgcctggtctgggtctcctgttgaaggacgccctccactgggaaggatcctcttgccttcaccacttgtcttcaccagcccctgctcccctcttcctcttggggctgttgtcgttgttgatactttttttttgttgtgtttgacacacatcttcttctcaccctctaacacagttctcaaccacagcacttttgtccctggagatgttggcagtgtccagaggcgtgttgatggtcccactggggttgggggtgctgctggcaccagatggtagggagatgccaggggtgctgctccacaccctatgggacactgcacagtacacctggcctgtgtcccccacagcgagagctggccctgggcaggcgtggtccctgcggtgtgtgttggttgggatcctccacagtgacagacggtgcgctctgcccacgtttccacacagctcttttgcttgtggagctcacccctttgcagagagctcatttccctgcggtctttggcctgcagaagtaaaatgaggggtggtgaattacacccctgctggttacacatggaaaactcaggagtgagaattttgtggagagcaagagaggtgagactggggtgctggctgccagccaggcggtccctcagcccctggagaagcggggtggggcctgcacaccgagtccttccagtgagtccagtgatgctctctcctcttcctcccagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactgggaa

SEQ ID NO: 550 - protein, 104 aa, Homo Sapien
MLAVSRGVLMVPLGLGVLLAPDGREMPGVLLHTLWDTAQYTWPVSPTARAGPGQAWSLRCVLVGILHSDRRCALPTFPHSSFACGAHPFAESSFPCGLWPAEVK

SEQ ID NO: 551 - DNA, 3141 bp, Homo Sapien
cgcccttagcatgggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcagcctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccctccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccacgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctacgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaatagccgtgagccggaatcctgcacggtgccacctc

SEQ ID NO: 552 - protein, 1032 aa, Homo Sapien [sequence omitted]

SEQ ID NO: 553 - DNA, 1234 bp, Homo Sapien
ggcgtgggacgtgctgcggcgtcctagctggcttacagggcggcggcggggtgtgtgtcctctgttaagagtgctactcgcccggggttgatctgtgcatgccactcctgggtcagacggtgaggtcggcgtctgcgaggacgcggcggtggagtagaagggcagccggagacaggcccggcgccccttccgaggctagacggccccagcttcgcggggatcatggcattgctggtggaccgagtgcggggccactggcgaatcgccgccgggctcctgttcaacctgctggtgtccatctgcattgtgttcctcaacaaatggatttatgtgtaccacggcttccccaacatgagcctgaccctggtgcacttcgtggtcacctggctgggcttgtatatctgccagaagctggacatctttgcccccaaaagtctgccgccctccaggctcctcctcctggccctcagcttctgtggctttgtggtcttcactaacctttctctgcagaacaacaccataggcacctatcagctggccaaggccatgaccacgccggtgatcatagccatccagaccttctgctaccagaaaaccttctccaccagaatccagctcacgctgattcctataactttaggtgtaatcctaaattcttattacgatgtgaagtttaatttccttggaatggtgtttgctgctcttggtgttttagttacatccctttatcaagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgcttatggtgctgctatctggagtaatagctttcatggtgaacttatcaatttattggatcattgggaacacttcacctgtcacctataacatgttcggacacttcaagttctgcattactttattcggaggatatgttttatttaaggatccactgtccattaatcaggcccttggcattttatgtacattatttggcattctcgcctatacccactttaagctcagtgaacaggaaggaagtaggagtaaactggcacaacgtccttaattgggtttttgtggagaaaagaatgttgtcccaagaagataaaaaatattgttaagtgtgcaagttatta

SEQ ID NO: 554 - protein, 313 aa, Homo Sapien
MALLVDRVRGHWRIAAGLLFNLLVSICIVFLNKWIYVYHGFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALLMVLLSGVIAFMVNLSIYWIIGNTSPVTYNMFGHFKFCITLFGGYVLFKDPLSINQALGILCTLFGILAYTHFKLSEQEGSRSKLAQRP

SEQ ID NO: 555 - DNA, 1773 bp, Homo Sapien
gttaggcagagccaaggtggttgcagacctggaatcagaacagcttttagaccaacctgaaagcaggaatgtaagcactgttcacagagattttcgtctttggcttattgtgcctgcagagtctagtgcttctttgccagctgtgctgactcagcactccatgcctgttttctggaaccagtccctggagctgggccatgttttgattgacagtgtggagctagcccagcaagtactctacatgcaaccccccacccaggcactacctctgctcctcctccatggcctcctgctacaccggcagctctatggaacaaggctgcaggcacacagggggcgctggagtcaagtgactctaacccaggttcttcagacccaagaccagctgtgggcaagtcttagcaatccccgtgctgccatgcaagagctggctgcttcagttttctacgggggtcctctgggggacactgaggacagggaggccctgattagcctcacacaagcctgcctgagccccagtagtgggagctgggtccagccacacacacctcagtctttgctggccacgctcatgcccctcccagctaagggagctggatgcaatggcagagtgcaaggcccagatgcacctactgccctcaccacctgaaccccggctctgcggactgagtgagggcccccaagcctggctgttgcgacgccagagtcgcgctctcttgagtgcgctgcagcggagttcacccgtgtgggttcctgagtctcgaagaggcgcccagcttgcggaaaggcgactgcggcaacgcctagtgcaagtcaaccggaggctggagtcactgcaggatctgctgacccacgtgattcgccaagacgagtccgacgccccgtggtcagtgctggggccaaatgcacggcggcctctggagggcgtcttagagaccgaggctctagaactgagccagttggtgggcacgctacaacgcgaccttgattgcctgttgcagcagctgaagggcgcacccccgtgcccctcccgccgctgtgctgcggtggcccacgctctctggactggccgcctacccttgccttggcgacctcatgcgccggccggtccgcagccgccctggcactggctgcgacagttgtcgcgccgtgggcaactgttggttcgttacttgggcgtgggcgcggacgcgagcagtgatgtaccagagcgcgtcttccacctgtcagcctttcgccacccgcgccgcctgctgctggcattgcgtggggaagctgccctggaccagaatgtgcccagctcgaatttccctggtagccgaggctcggtctccagtcagctccagtataaacgtctggagatgaacagcaaccctctgcacttcagggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgccagccccagccgacctgactgtgtactcgtgtcctgtgtacatgggagggccccttggcaccgctaagctgcagagcaggaacatcgtgatgcatctgcctttacccaccaagctcacccccaacacctgtgtccaaaggagggtccatgtgtgcagcccacccctgtcttgagcccgtctaccaaaataaagttgtagtgattcca

SEQ ID NO: 556 - protein, 162 aa, Homo Sapien
MPVFWNQSLELGHVLIDSVELAQQVLYMQPPTQALPLLLLHGLLLHRQLYGTRLQAHRGRWSQVTLTQVLQTQDQLWASLSNPRAAMQELAASVFYGGPLGDTEDREALISLTQACLSPSSGSWVQPHTPQSLLATLMPLPAKGAGCNGRVQGPDAPTALTT

SEQ ID NO: 557 - DNA, 1220 bp, Homo Sapien
gaccttgagccctcgaaagcgacatggcggttctcttaaagctgggcgttctctgcagtggccaaggagctcgagctctcctactccgaagccgggtggtcagacccgcttatgtgtcagcatttctccaggaccagcctacccaaggacggtgtggtacccagcacattcacctgtcaccaagccaccactctggttccaaggctgcatctctccactggaccagtgagagggttgtcagtgttctgctcttggggctgatccctgctgggtacttgaatccctgctctgtggtggactactctctggctgcagccctcaccctgcacagtcactggggccttggacaagtggttaccgactacgttcatggggacaccctgccgaaggctgccagggcaggcctcttggcactctcagctttgacctttgctgggctttgctacttcaattaccacgatgtcggcatctgcagagcggttgccatgctgtggaagctctgacctgggtgcagcactttgattgtgtgcctccttgcctctgctttaccaatgccgttcacctcgcagtgaggggggatgaaggataagcccattggtgggcagaatgtcttctaattacatggttattttcagaatttatttgttgaggaagaggtttgaggagttaggttcgaccattcgtgagtctgtgttccatactccactgagtgtgggcactagctcacagcctcgcggtgagactgaacatttcatgagctcatgttgcctttgaccaccatttcttaaggagagccagctgattgctgtcaggataagagcatctcttcagccaggagggaggcctgttccctcctgagttagactttgcatgaagctcgaaagtattccctttggaacctcccattcttgttcaggtgacaccagctctgttgatggctctgcttctagggaacatttaatcaggagatgctctcaatgactaatttgtctaagtcttaggaaggaggttgaggaaagctggatttagacaagttcaatttagggagttctccttgtttgtggattaaaatatgacagattgcaaacagactactcttcaaatgtatctcaattgtgcagaagtgagctgtccaaaagtataagactaagtgataaactgtcttcccaccgtgggagttgttaatgagaaagaaagtgtactctgaaaaaacaaggggg

SEQ ID NO: 558 - protein, 159 aa, Homo Sapien
MAVLLKLGVLCSGQGARALLLRSRVVRPAYVSAFLQDQPTQGRCGTQHIHLSPSHHSGSKAASLHWTSERVVSVLLLGLIPAGYLNPCSVVDYSLAAALTLHSHWGLGQVVTDYVHGDTLPKAARAGLLALSALTFAGLCYFNYHDVGICRAVAMLWKL

SEQ ID NO: 559 - DNA, 2473 bp, Homo Sapien
cccagccccgcgttcggctgctctcgaggaggccggagtccccggagacgatgcgccccgcgcagccgcctgcgcctgcgggagccggctgcccttgagatggagttgctgcctctttggctctgcctgggttttcacttcctgaccgtgggctggaggaacagaagcggaacagccacagcagcctcccaaggagtctgcaagttggtgggtggagccgctgactgccgagggcagagcctcgcttcggtgcccagcagcctcccgccccacgcccggatgctcaccctggatgccaaccctctcaagaccctgtggaatcactccctccagccttaccctctcctggagagcctcagcctgcacagctgccacctggagcgcatcagccgcggcgccttccaggagcaaggtcacctgcgcagcctggtcctgggggacaactgcctctcagagaactacgaagagacggcagccgccctccacgccctgccgggcctgcggaggctggacttgtcaggaaacgccctgacggaggacatggcagcgctcatgctccagaacctctcctcgctgcggtccgtgtccctggcggggaacaccatcatgcggctggacgactccgtcttcgagggcctggagcgtctccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgagccacaaccagctgtcggagctgcacctggctccggggctggccagctgcctgggcagcctgcgcttgttcaacctgagctccaaccagctcctgggcgtcccccctggcctcttcgccaatgctaggaacatcactacacttgacatgagccacaatcagatctcactttgtcccctgccagctgcctcggaccgggtgggcccccctagctgtgtggatttcaggaatatggcatctttaaggagcctgtctctggagggctgtggcctgggggcattgccagactgcccattccaagggacctccctgacctacttagacctctcaagcaactggggggttctgaatgggagcctcgccccactccaggatgttgcccccatgttacaggtcctgtctctcaggaacatgggcctccactccagctttatggcgttggacttctctgggtttgggaatctcagggacttagatctgtcggggaattgcttgaccaccttcccaaggtttgggggcagcctggccctggagaccctggatctccgtagaaactcgctcacagcccttccccagaaggctgtgtctgagcagctctcgagaggtctgcggaccatctacctcagtcagaatccatatgactgctgtggggtggatggctggggggccctgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggtcatcaagagccgctgccactggtcctccgtttactgacctggctgtgtgccaagactcgaaattcggtccgcacacaacaggacactttctctgccagctttcaagatgtgatgcagaggccaagtctgacgaattgaagtttcaattaaaatttaatatgtttccattcctcatcgcccaccccacccccgcccccaccaccgcccaagttctttttccatcattataattcatccttattatcttggtaaaatatttattaagtgactttttcagaaataaaaggcaacgtgtctcataaatattttttaaaaaaaaaaaaaaaaaaaaa

SEQ ID NO: 560 - protein, 692 aa, Homo Sapien
MELLPLWLCLGFHFLTVGWRNRSGTATAASQGVCKLVGGAADCRGQSLASVPSSLPPHARMLTLDANPLKTLWNHSLQPYPLLESLSLHSCHLERISRGAFQEQGHLRSLVLGDNCLSENYEETAAALHALPGLRRLDLSGNALTEDMAALMLQNLSSLRSVSLAGNTIMRLDDSVFEGLERLRELDLQRNYIFEIEGGAFDGLAELRHLNLAFNNLPCIVDFGLTRLRVLNVSYNVLEWFLATGGEAAFELETLDLSHNQLLFFPLLPQYSKLRTLLLRDNNMGFYRDLYNTSSPREMVAQFLLVDGNVTNITTVSLWEEFSSSDLADLRFLDMSQNQFQYLPDGFLRKMPSLSHLNLHQNCLMTLHIREHEPPGALTELDLSHNQLSELHLAPGLASCLGSLRLFNLSSNQLLGVPPGLFANARNITTLDMSHNQISLCPLPAASDRVGPPSCVDFRNMASLRSLSLEGCGLGALPDCPFQGTSLTYLDLSSNWGVLNGSLAPLQDVAPMLQVLSLRNMGLHSSFMALDFSGFGNLRDLDLSGNCLTTFPRFGGSLALETLDLRRNSLTALPQKAVSEQLSRGLRTIYLSQNPYDCCGVDGWGALQHGQTVADWAMVTCNLSSKIIRVTELPGGVPRDCKWERLDLGLLYLVLILPSCLTLLVACTVIVLTFKKPLLQVIKSRCHWSSVY

SEQ ID NO: 561 - DNA, 1060 bp, Homo Sapien
tggcctactggaaaaaaaaaaaaaaaaaaaaaaagtcacccgggcccgcggtggccacaacatggctgcggcgccggggctgctcttctggctgttcgtgctgggggcgctctggtgggtcccgggccagtcggatctcagccacggacggcgtttctcggacctcaaagtgtgcggggacgaagagtgcagcatgttaatgtaccgtgggaaagctcttgaagacttcacgggccctgattgtcgttttgtgaattttaaaaaaggtgacgatgtatatgtctactacaaactggcagggggatcccttgaactttgggctggaagtgttgaacacagttttggatattttccaaaagatttgatcaaggtacttcataaatacacggaagaagagctacatattccagcagatgagacagactttgtctgctttgaaggaggaagagatgattttaatagttataatgtagaagagcttttaggatctttggaactggaggactctgtacctgaagagtcgaagaaagctgaagaagtttctcagcacagagagaaatctcctgaggagtctcgggggcgtgaacttgaccctgtgcctgagcccgaggcattcagagctgattcagaggatggagaaggtgctttctcagagagcaccgaggggctgcagggacagccctcagctcaggagagccaccctcacaccagcggtcctgcggctaacgctcagggagtgcagtcttcgttggacacttttgaagaaattctgcacgataaattgaaagtgccgggaagcgaaagcagaactggcaatagttctcctgcctcggtggagcgggagaagacagatgcttacaaagtcctgaaaacagaaatgagtcagagaggaagtggacagtgcgttattcattacagcaaaggatttcgttggcatcaaaatctaagtttgttttacaaagattgtttttagtactaagctgccttggcagtttgcatttttgagccaaacaaaaatatattattttcccttctaagtaaaaaaaaaaaaaaaaaaaaa

SEQ ID NO: 562 - protein, 303 aa, Homo Sapien
MAAAPGLLFWLFVLGALWWVPGQSDLSHGRRFSDLKVCGDEECSMLMYRGKALEDFTGPDCRFVNFKKGDDVYVYYKLAGGSLELWAGSVEHSFGYFPKDLIKVLHKYTEEELHIPADETDFVCFEGGRDDFNSYNVEELLGSLELEDSVPEESKKAEEVSQHREKSPEESRGRELDPVPEPEAFRADSEDGEGAFSESTEGLQGQPSAQESHPHTSGPAANAQGVQSSLDTFEEILHDKLKVPGSESRTGNSSPASVEREKTDAYKVLKTEMSQRGSGQCVIHYSKGFRWHQNLSLFYKDCF

SEQ ID NO: 563 - DNA, 824 bp, Homo Sapien
gccagccgtgggattaggcttcgccggctacgattgcggcccccatcttctgacttttcctcgtgtgacccatcttttcaaattcccttacctgaggaaggagcccgattacaaggatatttacctgctcctaccctgatctagggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagagacagtgtttctcctctggaacagcctcaatgaccctctcttcggttggctcagtgaccggcagttcctcagctcccagccccgcctgtgtggagaggagctgcttgtgggcagtgaggaggcggacagcatcaccttgggccggtatctccggcagctggcacgccatcggaacttcctgtggttcgtgagcatggacctggtgcaggtgcagtggctcacgcctgtaatcccagcacttcgggacgccaaggtggaaagaccgcttgagcccaggagttcgaggctgcaatgagttatgattgcaccactgcactccagcctgggcggcagagaaaggctccatctctaaaaaaagaagagctaagtgctgtacctaaaacatgcagtatataaactggctgaacttagaaataaactgttttcatgttatgaaaa

SEQ ID NO: 564 - protein, 153 aa, Homo Sapien
MGLGQPQAWLLGLPTAVVYGSLALFTTILHNVFLLYYVDTFVSVYKINKMAFWVGETVFLLWNSLNDPLFGWLSDRQFLSSQPRLCGEELLVGSEEADSITLGRYLRQLARHRNFLWFVSMDLVQVQWLTPVIPALRDAKVERPLEPRSSRLQ

SEQ ID NO: 565 - DNA, 320 bp, Homo Sapien
cggcacgagtaaaatggagataatatcaccatgcactcagccctagccactgcattgctgttactgataccattactgctgctacgtcgtttttttgatggctcagcccttagggaagggggatcaagggagaagcccggaccttcccgcaggaggtgggctgggcacagccctgaaccatggaggtcacccaccctgaggtcgggacctgggttcccttcctatccactgggggtcccagcctttgtcttcatctctccaggtcccagcccttcacagtgggcacttccctgcctgtgacggaggccccagccatctcc

SEQ ID NO: 566 - protein, 89 aa, Homo Sapien [sequence omitted]

SEQ ID NO: 567 - DNA, 695 bp, Homo Sapien
agtctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggcctggcagcctcttcctggctagggggccagaacgcctctgaccacagcctgtggctcctgaggaagccccgaggctcatcctgccccggcacgggtcaccagctctgccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgc

SEQ ID NO: 568 - protein, 164 aa, Homo Sapien
MAAVGSLLGLAASSWLGGQNASDHSLWLLRKPRGSSCPGTGHQLCRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSDDLHVERYRQFWTRTKK

SEQ ID NO: 569 - DNA, 2457 bp, Homo Sapien
ggtgccaagggttcgggggggagcactgaggctttagcagctctcctgtatcctcatttgcatcctcctgtagcagctggaaaattcagattacaggtgaaattccctggctggcaatcttctgtatatggacacagtgatgtgccagaagggctttgcatccctgagactgaaggaagctccatttttggagccctcccacaccttgctctgtgtgcctctcattctgatttgaattcttattttgctatatgatgaagctgtaatcctaagtttaaaaaggggagtaggtattgacatcatggtagaaataggctgtcttatggaactgtagttagggatcacagcctattggaccagccccagccttagcagcagttctgtacactgattcttccagattagtctacgttccctcgaacagacctatgccatgggttacaactacaatttgttgtcgattagagttaacttacagactctcaaaaccccattctttgggtttaggcaacttccagaagtagtcatttatttgaattttagtctaagatcaactgaattagggaggtttgaaagtgtaaaagcaaatcgtacattcccaaacactttgtaaagaaggaatgggtagtgtcaactaaaggaaatggtgtgcatcccagcaaaagaaagagaccgaaagcaaagtcataaaccatgcccacgagctcagctgtcctgctccgtgtcctctccatacccttgttgactgtgctcatattagccagagacctaagtgctcttggaggatgtccctggggccccctccccctccgctgtcactgtctacttcctgatcctctcttctgtgcaggagaggtccaggccttctatgaggacctgagtggccggcagtacgtgaatgaagtcttcaacttcagcgtggacaagctctatgacctcctcttcaccaactcgcccttccagcgggatttcatggagcagcggcgcttctctgatatcatcttccatccatggaaaaaggaggagaatggaaaccagagccgagtgattctttacaccatcacccttaccaaccctctggctcccaaaactgccactgtcagggagacacagaccatgtacaaggcgagccaggagagtgaatgttacgtgatagatgccgaagtcctcacccacgacgtgccctaccacgactacttctacacaatcaatcgctacacgctcacccgtgtggctcggaacaagagccgactcagggtctccacagagctgcgctatcgaaaacagccctgggggttagtgaaaacgttcatcgagaagaacttctggagtgggctggaggactacttccgccatttagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggttccacacagacgcggcatatcccggaggacacccccaacggtttccacctgcagagcgtgtccaagctgctgctggttatcagctgtgttctggtgctgctggtcatccttaacatgatgctcttctacaaactctggatgttggaatacaccacgcagaccctcactgcctggcagggtctaaggctccaagaaaggttaccccagtctcagacagaatgggcccagctcttagagtcccaacaaaagtaccacgatactgagctccaaaaatggagggaaatcatcaaatcctcagtgatgctccttgaccagatgaaggactcgctcatcaaccttcagaacggcatcaggtcccgcgactacacgtcggaaagtgaagaaaagaggaatcgctatcattgacaaggcaggaacagggtggctgcaagaggcctgtgcaatacatgtacatagaccatataaatatatatatataaatatatatatatacagaatataaatatatatattatatacagattttaaaaaagagataatgcctatgtaccagggagaaggagcgggccctcccgcgccctgtgctggccggagcagcgttttcttatggtggagcagctgaggagggcaggaaccgcctctcagcaccgacctcccctgatctccctcctcccaccctctgttccccaccccttcccttgctggccattcttggcttttagaagggaaatgttgagccaaagttatgcctgcgaagaccctaaggtctcaaaaagaagtcttaagacggcattgcttaaggtgcttcattccctaatccccttttgatttgtttccaaaataaaagagaatcttttcttccctaaaaaaaaaaaaaaaaaaaaaaaaaaa

SEQ ID NO: 570 - protein, 425 aa, Homo Sapien
MPTSSAVLLRVLSIPLLTVLILARDLSALGGCPWGPLPLRCHCLLPDPLFCAGEVQAFYEDLSGRQYVNEVFNFSVDKLYDLLFTNSPFQRDFMEQRRFSDIIFHPWKKEENGNQSRVILYTITLTNPLAPKTATVRETQTMYKASQESECYVIDAEVLTHDVPYHDYFYTINRYTLTRVARNKSRLRVSTELRYRKQPWGLVKTFIEKNFWSGLEDYFRHLESELAKTESTYLAEMHRQSPKEKASKTTTVRRRKRPHAHLRVPHLEEVMSPVTTPTDEDVGHRIKHVAGSTQTRHIPEDTPNGFHLQSVSKLLLVISCVLVLLVILNMMLFYKLWMLEYTTQTLTAWQGLRLQERLPQSQTEWAQLLESQQKYHDTELQKWREIIKSSVMLLDQMKDSLINLQNGIRSRDYTSESEEKRNRYH

SEQ ID NO: 571 - DNA, 3244 bp, Homo Sapien
gtagagagtgaagcagcaagactgcagagcctcatcaagaagtgtggagtgaagggaaggcttcagatggacaatttgtgtgctggggaaaaaatggaatgtgctgcaaattcccctgtggataagggtggacggctgctctgtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatccttaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtccttctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctgatctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttgg

SEQ ID NO: 572 - protein, 364 aa, Homo Sapien
MKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHGHVHITDFNIATVVKGAERASSMAGTKPYMAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 573 - DNA, 3399 bp, Homo Sapien
ctccagttcgccgactgtaacatgtttcatccagttcagtatgttttgtatgcaagttggaaataaataaacgtcctgaactggatgaaacatgttacagtcggccgaaacatgagaggctgtgtgagaagctgcagccgccggcagaggagacctcagcatcatctagagcccagcgctggccctgcctccgcctgcgccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacgctggcacaactgcaaacggtgtcatccgcacaactttatctcgctcctcgggctcccctaaggcattggacccatcgccgcgtcttttatttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccagaaaaaatccacaccaagttgatttgagaacagccagagtctttcttgaagttgcagaactccacagaaagcatctgggaggacaactgctctttggccctgacggctttttgtacatcattcttggtgatgggatgattacactggatgatatggaagaaatggatgggttaagtgatttcacaggctcagtgctacggctggatgtggacacagacatgtgcaacgtgccttattccataccaaggagcaacccacacttcaacagcaccaaccagccccccgaagtgtttgctcatgggctccacgatccaggcagatgtgctgtggatagacatcccactgatataaacatcaatttaacgatactgtgttcagactccaatggaaaaaacagatcatcagccagaattctacagataataaaggggaaagattatgaaagtgagccatcacttttagaattcaagccattcagtaatggtcctttggttggtggatttgtataccggggctgccagtcagaaagattgtatggaagctacgtgtttggagatcgtaatgggaatttcctaactctccagcaaagtcctgtgacaaagcagtggcaagaaaaaccactctgtctcggcactagtgggtcctgtagaggctacttttccggtcacatcttgggatttggagaagatgaactaggtgaagtttacattttatcaagcagtaaaagtatgacccagactcacaatggaaaactctacaaaattgtagatcccaaaagacctttaatgcctgaggaatgcagagccacggtacaacctgcacagacactgacttcagagtgctccaggctctgtcgaaacggctactgcacccccacgggaaagtgctgctgcagtccaggctgggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcaggtattcttgatcagatcattgacatgacatcttacttgctggatctaacaagttacattgtatagtttctgggactgtttgaatattctattccaatgggcatttattttttatcctgtcattaaaaaaaaaaagactgttatcctgctacacactcctgtgatttcattctcttttattaatttaaaaataatttccagaaatgtgcagatcctctgtgtgtatgtcagcatgtttgttcacatatgcacatacacatactcataacccctatatgcgttgttgcataacagatgattttttaaaatatatacttccttatgcaaagtaatttacacagaaattccattgtaaattgataatggattttttatgttactagaagagattatttgacttcccaggaattttctgtctgtaatcactaaagtcaactttaatagagttttgaaacagtactgtgcaatccgatggatctaattaaaaaaaaggcaatatttttatattaaagtactatactaggagagaatgtttcagaactccctgatgaatttctaagtgagcaacttgatataaaattgtaatcttcatttttgtcagtgtatccagttacagaatgctacacacttacctttttattggctgagaaatctggttatttcatcttaatctcaagattgttttcaagtgttttataattaaatcataatagcatattttaaaatcaaaaa

SEQ ID NO: 574 - protein, 882 aa, Homo Sapien [sequence omitted]

SEQ ID NO: 575 - DNA, 2738 bp, Homo Sapien
cggctcgagagcggggcaaactgcttggcacctcttcaataggtgacattcaatgatagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgctaatatgcaagtgaaccagtgacctgcagttctgcccacacagggttaataaccaatcagattctctcttttcaagatggttaacataacagacaccaagaaagggaagaggagccgacagcagagggggaagctgaaaagacgcacaaagaatggccataaaagatatgagcaaccccagctttccagacagtcacttttcccagtggtcatacctggtctggaagattccccatcatctcgaataaagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattggtaaggatgtggttttattgacttgaaataacaaagcccgcaagcaacaactgatcatccgcgggatgctgccacaaggaataattgagcactcattcagacacaggggaaaccactgcctctttcagtctttctcccagattccaacagtcagtgttacagcatttcaccttgttcacctccctgagaagacgttgcagctcactcaccccagtgggcactgggagcctctgctcaggtgggagacagatgccccccacatgcacatctggtgtttatgaagcagatactggggcttcataaacacagaaggggcagggaagtagccccagggcatagtgtggggcctcctgactaaaagtagcttgcaaacccctgcctataacagccacttcctggcagtcattgtgccacttaggagccctcctcaccgctcttcctttagttccttcactctgtatagaccctgccagagcagctcagggtggagcagctgcagccatgggacctgctccaggcaaggccctatgctacacagtccctgggggtgaggattccagaggagtcaattccctacccgcccttccaggggatggccgagatgagcgttcccacagggaaagtgaaagttgcaaggctgttgcggaaacaccaggggttccatttaggtcttgctgctcatctcacagaaagccagtcactgagacaagtattgtcagggaagaaggctttatccaggtgctacagacagggtgaacaagagatcagtctcaaatccatcatcatcaactgactaaaattaggggtttatatagcagggaagaaatgtaactacatgtgggaaaacagggattaacgaggggcaaggaagaggagttggccaacaggcagcaggtggtcacctggggaatcatgatgggtgaggggtctggcttctcactttccagatgtggggatctggtaaatttcagtttcttgataccgtctgggaggattgctggctggtttcctgagaaaggaattcagatgacataaatgtaaatttctccttgggtttcaagactgagagggtcaatttctaggtttattcaagaaaaaccataaacatcagttctatgggacaattgggcccatttcaaggctctgaggataagggttaatgaggggacagagtcgcctggagaagttcactggggcctacaagaaactagagaggcttcctggcaaagctctatgctgtctatcctctcttctctccttgcaggaagattccagtataatagacccgaggtgaaaaggcttttgttcaataagtagaaaactgaaggggggtgggaggcacatggatttgaaccagagaccgcttggcctgcaggcaaatgctgtaccttcagttgcacccctcacttgttacagctgtttctgataagcacttgtgcagccccatcagcacctcgatttcttcttggtgagtccatgggaacagccccactgcaaacaacccattcctgctctcctctttcctctaaacctcaacctcctcctacctggcagtccacaggcctacagcttctcctcagtgggaaagacatcagcttggaaaaccacttggaaagccaacgttatcctagaaaagctttttaaatgacccagcaggacaagtctccggatggccttggccaacccggtgcttccctcttttcttggttgtagttctcagaataactagagaatgtactgggagtgttgtcctgagataaggaggaactgtcctaaacctggactctgttcccatcacacctagaacaggatgtcctgcaacgctttagcccaatgatccaagttgcccttggggtataaaacttgacagcagagggcgttcagggtccctcagctgcagtgtgaagtgggacacacaggtgagactccatctgccctgggcaggttcctgagccttgggggaccagttcaccctacatcccaggcttctgttgtcccttgcctgcctgtaaggaataaagttgctttgctta

SEQ ID NO: 576 - protein, 80 aa, Homo Sapien
MIDLWLPALFVLVALESLLLSPCPGTSSTLTRTFFPSLVSCVQVPFSWIPCLECFLIYFLILAEDVLQLFSGNANMQVNQ

SEQ ID NO: 577 - DNA, 732 bp, Homo Sapien
atcggttagcgccttgccatgattaatccagagctgcgggatggcagagctgatggcttcatacatcggatagttcccaagttgatacaaaactggaagattggccttatgtgcttcctgagtattattattactacagtttgcattattatgatagccacatggtccaagcatgctaaacctgtggcatgttcaggggactggcttggagtgagagataagtgtttctatttttctgatgataccagaaattggacagccagtaaaatattttgtagtttgcagaaagcagaacttgctcagattgatacacaagaagacatggaatttttgaagaggtacgcaggaactgatatgcactggattggactaagcaggaaacaaggagattcttggaaatggacaaatggcaccacattcaatggttggccatcaaactccaaatggtcttgcaactggagcctccgacaatggcttcttctgctgggaccccttagataggcctctgagggagctctgactgccgtttccccaaaacaatgtcccctgtcagcaggaagcagttaaatcagtcttcatccttatccttaatataacggcagttagatgtacttctttagagggagtaaatttatcaattcagagcaattcatcctcctctttccatctttgattcacagttaataggctataaattttgataatgtagaataaactacagaaaacttcttg

SEQ ID NO: 578 - protein, 100 aa, Homo Sapien
DWLGVRDKCFYFSDDTRNWTASKIFCSLQKAELAQIDTQEDMEFLKRYAGTDMHWIGLSRKQGDSWKWTNGTTFNGWPSNSKWSCNWSLRQWLLLLGPLR

SEQ ID NO: 579 - DNA, 925 bp, Homo Sapien
tgaaggcctgtgagtgaggaatgcctctcaccagctgtgcctgagctgcagcactccagccactgctgtctccttagctgctcacatatggatactttcacagttcaggattccactgcaatgagctggtggaggaataatttctggatcatcttagctgtggccatcattgttgtctctgtgggcctgggcctcatcctgtactgtgtctgtaagtggcagcttagacgaggcaagaaatgggaaattgccaagcccctgaaacacaagcaagtagatgaagaaaagatgtatgagaatgttcttaatgagtcgccagttcaattaccgcctctgccaccgaggaattggccttctctagaagactcttccccacaggaagccccaagtcagccgcccgctacatactcactggtaaataaagttaaaaataagaagactgtttccatcccaagctacattgagcctgaagatgactatgacgatgttgaaatccctgcaaatactgaaaaagcatcattttgaaacagccatttcttctttttggcaaaactgaagagggttcacacaacttattttaaaacaatcaagaatggttgaacttcagtaggtctctgggccctgaaagccagtggtgattttatgaagctctataagataaagcacttcccaaaccttagatgaagacacccctgcgatcggatgactgcagccagaggagacacatgggtgctcggctctgaggacttagaggggtcagccttgtgctgttgaggaaactttccatgggaaggaccacggggctccatggctcccacctgtgggaaactactcatttcttggcattctttcccccttcattccctttggtttgcatggttctgagtgatattaaatctcagcatttggttgtgcaaaaaaaaaa

SEQ ID NO: 580 - protein, 145 aa, Homo Sapien
MDTFTVQDSTAMSWWRNNFWIILAVAIIVVSVGLGLILYCVCKWQLRRGKKWEIAKPLKHKQVDEEKMYENVLNESPVQLPPLPPRNWPSLEDSSPQEAPSQPPATYSLVNKVKNKKTVSIPSYIEPEDDYDDVEIPANTEKASF

SEQ ID NO: 581 - protein, 1435 aa, Homo Sapien
GGCCGCCTCCGCGGGGCTGTGGGAAGCTTGGGCTGTCCCAGGACCGTCAGTCTCCTCCTCTGACCCTCCCTTTCCCCTTGTGTGTAGGGCCGCCGTCCCACCCCCACCTCGCCGGAGTCCGGGGCGGCCCCGGTGTCCCCTCCGAGCCTGCTGCACTCCACGTCCCCCTACCAGGGCTCCAGCCCCCAGGGAAATCTCCGACCAGGCCCGCCCAGGAGCCAGATCCAGGCTCCTGGAAGAACCATGTCCGGCAGCTACTGGTCATGCCAGGCACACACTGCTGCCCAAGAGGAGCTGCTGTTTGAATTATCTGTGAATGTTGGGAAGAGGAATGCCAGAGCTGCCGGCTGAAAATTACCCAACCAAGAGAAATCTGCAGGATGGACTTTCTGGTCCTCTTCTTGTTCTACCTGGCTTCGGTGCTGATGGGTCTTGTTCTTATCTGCGTCTGCTCGAAAACCCATAGCTTGAAAGGCCTGGCCAGGGGAGGAGCACAGATATTTTCCTGTATAATTCCAGAATGTCTTCAGAGAGCCGTGCATGGATTGCTTCATTACCTTTTCCATACGAGAAACCACACCTTCATTGTCCTGCACCTGGTCTTGCAAGGGATGGTTTATACTGAGTACACCTGGGAAGTATTTGGCTACTGTCAGGAGCTGGAGTTGTCCTTGCATTACCTTCTTCTGCCCTATCTGCTGCTAGGTGTAAACCTGTTTTTTTTCACCCTGACTTGTGGAACCAATCCTGGCATTATAACAAAAGCAAATGAATTATTATTTCTTCATGTTTATGAATTTGATGAAGTGATGTTTCCAAAGAACGTGAGGTGCTCTACTTGTGATTTAAGGAAACCAGCTCGATCCAAGCACTGCAGTGTGTGTAACTGGTGTGTGCACCGTTTCGACCATCACTGTGTTTGGGTGAACAACTGCATCGGGGCCTGGAACATCAGGTACTTCCTCATCTACGTCTTGACCTTGACGGCCTCGGCTGCCACCGTCGCCATTGTGAGCACCACTTTTCTGGTCCACTTGGTGGTGATGTCAGATTTATACCAGGAGACTTACATCGATGACCTTGGACACCTCCATGTTATGGACACGGTCTTTCTTATTCAGTACCTGTTCCTGACTTTTCCACGGATTGTCTTCATGCTGGGCTTTGTCGTGGTTCTGAGCTTCCTCCTGGGTGGCTACCTGTTGTTTGTCCTGTATCTGGCGGCCACCAACCAGACTACTAACGAGTGGTACAGAGGTGACTGGGCCTGGTGCCAGCGTTGTCCCCTTGTGGCCTGGCCTCCGTCAGCAGAGCCCCAAGTCCACCGGAACATTCACTCCCATGGGCTTCGGAGCAACCTTCAAGAGATCTTTCTACCTGCCTTTCCATGTCATGAGAGGAAGAAACAAGAATGACAAGTGTATGACTGCCTTTG

SEQ ID NO: 582 - protein, 344 aa, Homo Sapien
MDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHCSVCNWCVHRFDHHCVWVNNCIGAWNIRYFLIYVLTLTASAATVAIVSTTFLVHLVVMSDLYQETYIDDLGHLHVMDTVFLIQYLFLTFPRIVFMLGFVVVLSFLLGGYLLFVLYLAATNQTTNEWYRGDWAWCQRCPLVAWPPSAEPQVHRNIHSHGLRSNLQEIFLPAFPCHERKKQE

SEQ ID NO: 583 - DNA, 2973 bp, Homo Sapien
ccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggcccgtcgccccatttcctgcaacagccagaggacctggtggtgctgctgggggaggaagcccggctgccgtgtgctctgggcgcctactgggggctagttcagtggactaagagtgggctggccctagggggccaaagggacctaccagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccacctttcatcagaccctgctgaaggaagggacccctgggtcagtggagagcaccttaaccctgacccctttcagccatgatgatggagccacctttgtctgccgggcccggagccaggccctgcccacaggaagagacacagctatcacactgagcctgcagtaccccccagaggtgactctgtctgcttcgccacacactgtgcaggagggagagaaggtcattttcctgtgccaggccacagcccagcctcctgtcacaggctacaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtttgggccgattctgcaggcaaagccggagcccgtgtccgtggacgtgggggaagacgcttccttcagctgcgcctggcgcgggaacccgcttccacgggtaacctggacccgccgcggtggcgcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacgctcccccagtagtgaccgccctgcactctgcgcctgccttcctgaggggccctgctcgcctccagtgtctggttttcgcctctcccgccccagatgccgtggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaaccggctgggcgagggaggtgcccaggccagcctgggccgtagagacttgctgcccactgtgcggatagtggccggagtggccgctgccaccacaactctccttatggtcatcactggggtggccctctgctgctggcgccacagcaaggcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggaggaagggactctggagaccaaggacccaaccaacggttactacaaggtccgaggagtcagtgtgagcctgagccttggcgaagcccctggaggaggtctcttcctgccaccaccctccccccttgggcccccagggacccctaccttctatgacttcaacccacacctgggcatggtccccccctgcagactttacagagccagggcaggctatctcaccacaccccaccctcgagctttcaccagctacatcaaacccacatcctttgggcccccagatctggcccccgggactccccccttcccatatgctgccttccccacacctagccacccgcgtctccagactcacgtgtgacatctttccaatggaagagtcctgggatctccaacttgccataatggattgttctgatttctgaggagccaggacaagttggcgaccttactcctccaaaactgaacacaaggggagggaaagatcattacatttgtcaggagcatttgtatacagtcagctcagccaaaggagatgccccaagtgggagcaacatggccacccaatatgcccacctattccccggtgtaaaagagattcaagatggcaggtaggccctttgaggagagatggggacagggcagtgggtgttgggagtttggggccgggatggaagttgtttctagccactgaaagaagatatttcaagatgaccatctgcattgagaggaaaggtagcataggatagatgaagatgaagagcataccaggccccaccctggctctccctgaggggaactttgctcggccaatggaaatgcagccaagatggccatatactccctaggaacccaaaatggccaccatcttgattttactttccttaaagactcagaaagacttggacccaaggagtggggatacagtgagaattaccactgttggggcaaaatattgggataaaaatatttatgtttaataataaaaaaaagtcaaagagaaaaaaaa

SEQ ID NO: 584 - protein, 708 aa, Homo Sapien
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEEGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 585 - DNA, 2476 bp, Homo Sapien
gcccgcctgaggaagccgtgtgcctgggatgccaagagccagagaatggatcttctccgagtggggacattgctgacaatcccggcttcccgaggcggctaagaacaggcagtttgtgtcggctggctgcagatacccagaggcacaaagagaccgaagccacccggagggacccacggacggacagatggtaggcgcgaacccgagaggaccggcggaggctgagcaccgagagccgccaaggaagagaaactaaccacagccaagttaccccgccggctttccttcgctgcgctaaggaatgaaacccttccagctcgatctgctcttcgtctgcttcttcctcttcagtcaagagctgggcctccagaagagaggatgctgtctggtgctgggctacatggccaaggacaagtttcggagaatgaatgaaggccaagtctattccttcagccagcagccccaggaccaggtggtggtgtcgggacagccagtgacgctactttgcgccatccccgaatacgatggcttcgttctgtggatcaaggacggcttggctctgggtgtgggcagggacctctcaagttacccacagtacctggtggtagggaaccacctgtcaggggagcaccacctgaagatcctgagggcagagctgcaagacgatgcggtgtacgagtgccaggccatccaggccgccatccgctcccgccccgcacgcctcacagtcctggtgccgcctgatgaccccgtcatcctggggggccctgtgatcagcctgcgtgcgggggaccctctcaacctcacctgccacgcagacaatgccaagcctgcagcctccatcatctggttgcgaaagggagaggtcatcaatggggccacctactccaagaccctgcttcgggacggcaagcgggagagcatcgtcagcaccctcttcatctcccctggtgacgtggagaatggccagagcatcgtgtgtcgtgccaccaacaaagccatccccggaggaaaggagacgtcggtcaccattgacatccagcaccctccactggtcaacctctcggtggagccacagccagtgctggaggacaacgtcgtcactttccactgctctgcaaaggccaacccagctgtcacccagtacaggtgggccaagcggggccagatcatcaaggaggcatctggagaggtgtacaggaccacagtggactacacgtacttctcagagcccgtctcctgtgaggtgaccaacgccctgggcagcaccaacctcagccgcacggttgacgtctactttgggccccggatgaccacagaaccccaatccttgctcgtggatctgggctctgatgccatcttcagctgcgcctggaccggcaacccatccctgaccatcgtctggatgaagcggggctccggagtggtcctgagcaatgagaagaccctgaccctcaaatccgtgcgccaggaggacgcgggcaagtacgtgtgccgggctgtggtgccccgtgtgggagccggggagagagaggtgaccctgaccgtcaatggaccccccatcatctccagcacccagacccagcacgccctccacggcgagaagggccagatcaagtgcttcatccggagcacgccgccgccggaccgcatcgcctggtcctggaaggagaacgttctggagtcgggcacatcggggcgctatacggtggagaccatcagcaccgaggagggcgtcatctccaccctgaccatcagcaacatcgtgcgggccgacttccagaccatctacaactgcacggcctggaacagcttcggctccgacactgagatcatccggctcaaggagcaaggttcggaaatgaagtcgggagccgggctggaagcagagtctgtgccgatggccgtcatcattggggtggccgtaggagctggtgtggccttcctcgtccttatggcaaccatcgtggcgttctgctgtgcccgttcccagagaagtacgggagggagatccgggatctcagggagggggacagagaaaaaggccaggcttaggctgccccggagagcaagtaagcaggagtgcaatgaacaggggtcctaacagtgctgtgagctcctggggcagggagtgggtctgatgcatcggtgtatgtgagcctgggcaacatggcgcctggcagagtgggcgctaggctgaggttgacctggactagactgaacttcatctgcagggcagccagcattttggattgaacacatagctctttcagtcaggaactgtacagaaagatagggggaaaagcggtttgtggtttgatccttgctctacaagagctgttagtctagagagaccccatctctacaacaaaataaaaataaagagctgctagtctcaccagaaaagcaggtcactcacacagctgtgggggagtgggtggggaagcaataaaggaattgctttgagaaaacttaa

SEQ ID NO: 586 - protein, 600 aa, Homo Sapien
MKPFQLDLLFVCFFLFSQELGLQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQGSEMKSGAGLEAESVPMAVIIGVAVGAGVAFLVLMATIVAFCCARSQRSTGGRSGISGRGTEKKARLRLPRRASKQECNEQGS

SEQ ID NO: 587 - DNA, 1248 bp, Homo Sapien
caaaaaaggagcatgtcttcatccatgagaggcctcgaaaaatcaatggtatttgcatttctcccaagaaggttgcttgccaaaacctttcggccattttctgctttcagagtgagacaaagttcaaaatgacagtctgtcagctcattgaaggcactagataccctgcctgcaggtaccactattcccccacagaggggtttgttcttgtcacttgtgatgacttgaggccagatagtttccttggctatgttaaataactcaagatcagctaccgagtctgagatctcttctctcatggcattggagctggctgtgcctgaggcagacctggaccgtggacatggggcaatgccttgagcggaaggggaagccactgaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgataccg

SEQ ID NO: 588 - protein, 199 aa, Homo Sapien
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 589 - DNA, 1510 bp, Homo Sapien
cagtcctgccgggacggtgagcgcattcagcaccctggacagcaccgcggttgcgctgcctccagggcggccccgggctgctcctgctccgcagagctacgccctccccccgggtgccccggaccctgcacttgccgccgctttcctcgcgctgctctggaccttgctagccggctctgcacctcccagaagccgtgggcgcgccgctcagctgctccatcgcctcactttcccaggctcgcgcccgaagcagagccatgagaaccccagggtgcctggcgagccgctagcgccatgggccccggcgaggcgctgctggcgggtctcctggtgatggtactggccgtggcgctgctatccaacgcactggtgctgctttgttgcgcctacagcgctgagctccgcactcgagcctcaggcgtcctcctggtgaatctgtctctgggccacctgctgctggcggcgctggacatgcccttcacgctgctcggtgtgatgcgcgggcggacaccgtcggcgcccggcgcatgccaagtcattggcttcctggacaccttcctggcgtccaacgcggcgctgagcgtggcggcgctgagcgcagaccagtggctggcagtgggcttcccactgcgctacgccggacgcctgcgaccgcgctatgccggcctgctgctgggctgtgcctggggacagtcgctggccttctcaggcgctgcacttggctgctcgtggcttggctacagcagcgccttcgcgtcctgttcgctgcgcctgccgcccgagcctgagcgtccgcgcttcgcagccttcaccgccacgctccatgccgtgggcttcgtgctgccgctggcggtgctctgcctcacctcgctccaggtgcaccgggtggcacgcagacactgccagcgcatggacaccgtcaccatgaaggcgctcgcgctgctcgccgacctgcaccccagtgtgcggcagcgctgcctcatccagcagaagcggcgccgccaccgcgccaccaggaagattggcattgctattgcgaccttcctcatctgctttgccccgtatgtcatgaccaggctggcggagctcgtgcccttcgtcaccgtgaacgcccagtggggcatcctcagcaagtgcctgacctacagcaaggcggtggccgacccgttcacgtactctctgctccgccggccgttccgccaagtcctggccggcatggtgcaccggctgctgaagagaaccccgcgcccagcatccacccatgacagctctctggatgtggccggcatggtgcaccagctgctgaagagaaccccgcgcccagcgtccacccacaacggctctgtggacacagagaatgattcctgcctgcagcagacacactgagggcctggcagggctcatcgcccccaccttctaagaagccctgtggaaagggcactggccctgccacagagatgccactggggacccccagacaccagtggcttgactttgagctaaggctgag

SEQ ID NO: 590 - protein, 363 aa, Homo Sapien
MGPGEALLAGLLVMVLAVALLSNALVLLCCAYSAELRTRASGVLLVNLSLGHLLLAALDMPFTLLGVMRGRTPSAPGACQVIGFLDTFLASNAALSVAALSADQWLAVGFPLRYAGRLRPRYAGLLLGCAWGQSLAFSGAALGCSWLGYSSAFASCSLRLPPEPERPRFAAFTATLHAVGFVLPLAVLCLTSLQVHRVARRHCQRMDTVTMKALALLADLHPSVRQRCLIQQKRRRHRATRKIGIAIATFLICFAPYVMTRLAELVPFVTVNAQWGILSKCLTYSKAVADPFTYSLLRRPFRQVLAGMVHRLLKRTPRPASTHDSSLDVAGMVHQLLKRTPRPASTHNGSVDTENDSCLQQTH

SEQ ID NO: 591 - DNA, 2037 bp, Homo Sapien
aacatggctgcggcgcctgggctgctcgtctggctgctcgtgctccggctgccctggcgggtgccgggccagctggaccccagcactggccggcggttctcggagcacaaactctgcgcggacgacgaatgcagcatgatgtaccgcggtgaggctcttgaagatttcacaggcccggattgtcgttttgtgaattttaaaaaaggtgatcctgtatatgtttactataaactggcaagaggatggcctgaagtttgggctggaagtgttggacgcacttttggatattttccaaaagatttaatccaggtagttcatgaatataccaaagaagagctacaagttccaacagatgagacggattttgtttgttttgatggaggaagagatgattttcataattataatgtagaagaacttttagggtttttggaactgtacaattctgcagctacagattctgagaaagctgtagaaaaaactttacaggatatggaaaaaaaccctgaattatctaaggaaagggaacctgaacctgaaccagtagaagccaactcagaggaaagtgatagtgtattctcagaaaacactgaggatcttcaggaacagtttacaactcagaagcaccactcccatgcaaacagccaagcaaatcatgctcagggagagcaggcttcatttgaatcttttgaagaaatgctgcaagataaactaaaagtgccagaaagtgaaaacaacaaaaccagcaatagttctcaggtctcaaatgaacaggataagattgatgcctataaacttttgaaaaaagaaatgactctagacttgaaaaccaaatttggctcaacagctgatgcacttgtatctgatgatgagacaaccagactcgttacttcattagaagatgattttgatgaggaattggatactgagtattatgcagttggaaaggaagatgaggagaaccaagaagactttgatgagttgccattacttacctttacagatggggaagatatgaaaactccagcaaagtctggcgttgagaaatatccaacagataaagagcagaattcaaatgaagaggacaaggttcagctaactgtgccccctggcatcaaaaatgatgataaaaatatactaacaacctggggggacactatcttctctattgtcacaggaggtgaagaaacaagagatacgatggatttagagagctctagttcagaggaagaaaaagaagatgatgatgatgcattagtcccagatagcaaacaggggaaaccacagtcagcaacagattatagtgaccctgacaatgtagatgatggtctttttattgtagacattcctaaaacaaataatgacaaagaagtaaacgcagaacatcacattaaaggaaaagggaggggagttcaggaatccaagaggggcctggtacaagatgagacagaattagaggatgaaaatcaagaaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttaaaaaaaaaaaaaa

SEQ ID NO: 592 - protein, 499 aa, Homo Sapien
MAAAPGLLVWLLVLRLPWRVPGQLDPSTGRRFSEHKLCADDECSMMYRGEALEDFTGPDCRFVNFKKGDPVYVYYKLARGWPEVWAGSVGRTFGYFPKDLIQVVHEYTKEELQVPTDETDFVCFDGGRDDFHNYNVEELLGFLELYNSAATDSEKAVEKTLQDMEKNPELSKEREPEPEPVEANSEESDSVFSENTEDLQEQFTTQKHHSHANSQANHAQGEQASFESFEEMLQDKLKVPESENNKTSNSSQVSNEQDKIDAYKLLKKEMTLDLKTKFGSTADALVSDDETTRLVTSLEDDFDEELDTEYYAVGKEDEENQEDFDELPLLTFTDGEDMKTPAKSGVEKYPTDKEQNSNEEDKVQLTVPPGIKNDDKNILTTWGDTIFSIVTGGEETRDTMDLESSSSEEEKEDDDDALVPDSKQGKPQSATDYSDPDNVDDGLFIVDIPKTNNDKEVNAEHHIKGKGRGVQESKRGLVQDETELEDENQEGFKTEPIKL

SEQ ID NO: 593 - DNA, 1209 bp, Homo Sapien
gggccagtagagtgtgtctgggtcagctgagtgactacatcaaagctcccagccttgaaaaacacatgctgttcccaggcctcaagatattgaaacattaattagataatttaaagtagcgttttcttctacaatgtctgaagaagtgacctacgcgacactcacatttcaggattctgctggagcaaggaataaccgagatggaaataacctaagaaaaagagggcatccagctccatctcccatttggcgtcatgctgctctgggtctggtaactctttgcctgatgttgctgattgggctggtgacgttggggatgatgtttttgcagatatctaatgacattaactcagattcagagaaattgagtcaacttcagaaaaccatccaacagcagcaggataacttatcccagcaactgggcaactccaacaacttgtccatggaggaggaatttctcaagtcacagatctccagtctactgaagaggcaggaacaaatggccatcaaactgtgccaagagctaatcattcatacttcagaccacagatgtaatccatgtcctaagatgtggcaatggtaccaaaatagttgctactattttacaacaaatgaggagaaaacctgggctaacagtagaaaggactgcatagacaagaactccaccctagtgaagatagacagtttggaagaaaaggattttcttatgtcacagccattactcatgttttcgttcttttggctgggattatcatgggactcctctggcagaagttggttctgggaagatggctctgttccctctccatccttgtacgtctctaactattgagggtaaacacaagctttccatggaatcctgggaaaattaataatgattgtgagaattataaatacagacataaaaagaggagtacaacatactgagaaaagagctccagtaacaaatattgaaaggagatttagtactaaagaacttgaccagatcaatggatccaaaggatgtgcttattttcaaaaaggaaatatttatatttctcgctgtagtgctgaaattttttggatttgcgagaagacagctgccccagtgaagactgaggatttggattagtatgcttcttccaaattctccaagaagtaagagacttgtgagtaagctcatatgaggaaagaggaaactacggtaccagagcaagggcgaattctgca

SEQ ID NO: 594 - protein, 232 aa, Homo Sapien [sequence omitted]

SEQ ID NO: 595 - DNA, 1107 bp, Homo Sapien
cggacgcgtggggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctatgctgacagcgtggccaggcgactgcagtcacgtctccaacaaccaagttgtgttgcttgatacaacaactgtactgggagagctaggatggaaaacatatccattaaatgggtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatggagcctccaaaggccgctgcttctagttggccatcttggccccaccccgaaacagtaacctttgaagaataaaagaaaaagcaaaagagtagcattactaaaatattaaacggttacatttacaaaaaaaaaaaaaaaaaaaaaaaaaa

SEQ ID NO: 596 - protein, 285 aa, Homo Sapien [sequence omitted]

SEQ ID NO: 597 - DNA, 2380 bp, Homo Sapien
acactggccaaacaaaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctaaaaaaa

SEQ ID NO: 598 - protein, 705 aa, Homo Sapien
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 599 - DNA, 1297 bp, Homo Sapien
ggtccttaatggcagcagccgccgctaccaagatccttctgtgcctcccgcttctgctcctgctgtccggctggtcccgggctgggcgagccgaccctcactctctttgctatgacatcaccgtcatccctaagttcagacctggaccacggtggtgtgcggttcaaggccaggtggatgaaaagacttttcttcactatgactgtggcaacaagacagtcacacctgtcagtcccctggggaagaaactaaatgtcacaacggcctggaaagcacagaacccagtactgagagaggtggtggacatacttacagagcaactgcgtgacattcagctggagaattacacacccaaggaacccctcaccctgcaggcaaggatgtcttgtgagcagaaagctgaaggacacagcagtggatcttggcagttcagtttcgatgggcagatcttcctcctctttgactcagagaagagaatgtggacaacggttcatcctggagccagaaagatgaaagaaaagtgggagaatgacaaggttgtggccatgtccttccattacttctcaatgggagactgtataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagagtcctttagagtgacaggttaaagctgataccaaaaggctcctgtgagcacggtcttgatcaaactcgcccttctgtctggccagctgcccacgacctacggtgtatgtccagtggcctccagcagatcatgatgacatcatggacccaatagctcattcactgccttgattccttttgccaacaattttaccagcagttatacctaacatattatgcaattttctcttggtgctacctgatggaattcctgcacttaaagttctggctgactaaacaagatatatcattttctttcttctctttttgtttggaaaatcaagtacttctttgaatgatgatctctttcttgcaaatgatattgtcagtaaaataatcacgttagacttcagacctctggggattctttccgtgtcctgaaagagaatttttaaattatttaataagaaaaaatttatattaatgattgtttcctttagtaatttattgttctgtactgatatttaaataaagagttctatttcccaaaaaaaaaaaaaaaaaa

SEQ ID NO: 600 - protein, 246 aa, Homo Sapien
MAAAAATKILLCLPLLLLLSGWSRAGRADPHSLCYDITVIPKFRPGPRWCAVQGQVDEKTFLHYDCGNKTVTPVSPLGKKLNVTTAWKAQNPVLREVVDILTEQLRDIQLENYTPKEPLTLQARMSCEQKAEGHSSGSWQFSFDGQIFLLFDSEKRMWTTVHPGARKMKEKWENDKVVAMSFHYFSMGDCIGWLEDFLMGMDSTLEPSAGAPLAMSSGTTQLRATATTLILCCLLIILPCFILPGI

SEQ ID NO: 601 - DNA, 1841 bp, Homo Sapien
gcagtcagagacttcccctgcccctcgctgggaaagaacattaggaatgccttttagtgccttgcttcctgaactagctcacagtagcccggcggcccagggcaatccgaccacatttcactctcaccgctgtaggaatccagatgcaggccaagtacagcagcacgagggacatgctggatgatgatggggacaccaccatgagcctgcattctcaagcctctgccacaactcggcatccagagccccggcgcacagagcacagggctccctcttcaacgtggcgaccagtggccctgaccctgctgactttgtgcttggtgctgctgatagggctggcagccctggggcttttgttttttcagtactaccagctctccaatactggtcaagacaccatttctcaaatggaagaaagattaggaaatacgtcccaagagttgcaatctcttcaagtccagaatataaagcttgcaggaagtctgcagcatgtggctgaaaaactctgtcgtgagctgtataacaaagctggagcacacaggtgcagcccttgtacagaacaatggaaatggcatggagacaattgctaccagttctataaagacagcaaaagttgggaggactgtaaatatttctgccttagtgaaaactctaccatgctgaagataaacaaacaagaagacctggaatttgccgcgtctcagagctactctgagtttttctactcttattggacagggcttttgcgccctgacagtggcaaggcctggctgtggatggatggaacccctttcacttctgaactgttccatattataatagatgtcaccagcccaagaagcagagactgtgtggccatcctcaatgggatgatcttctcaaaggactgcaaagaattgaagcgttgtgtctgtgagagaagggcaggaatggtgaagccagagagcctccatgtcccccctgaaacattaggcgaaggtgactgattcgccctctgcaactacaaatagcagagtgagccaggcggtgccaaagcaagggctagttgagacattgggaaatggaacataatcaggaaagactatctctctgactagtacaaaatgggttctcgtgtttcctgttcaggatcaccagcatttctgagcttgggtttatgcacgtatttaacagtcacaagaagtcttatttacatgccaccaaccaacctcagaaacccataatgtcatctgccttcttggcttagagataacttttagctctctttcttctcaatgtctaatatcacctccctgttttcatgtcttccttacacttggtggaataagaaactttttgaagtagaggaaatacattgaggtaacatccttttctctgacagtcaagtagtccatcagaaattggcagtcacttcccagattgtaccagcaaatacacaaggaattctttttgtttgtttcagttcatactagtcccttcccaatccatcagtaaagaccccatctgccttgtccatgccgtttcccaacagggatgtcacttgatatgagaatctcaaatctcaatgccttataagcattccttcctgtgtccattaagactctgataattgtctcccctccataggaatttctcccaggaaagaaatatatccccatctccgtttcatatcagaactaccgtccccgatattcccttcagagagattaaagaccagaaaaaagtgagcctcttcatctgcacctgtaatagtttcagttcctattttcttccattgacccatatttatacctttcaggtactgaagatttaataataataaatgtaaatactgtgaaaaa

SEQ ID NO: 602 - protein, 280 aa, Homo Sapien [sequence omitted]

SEQ ID NO: 603 - DNA, 957 bp, Homo Sapien
gggagagaggataaatagcagcgtggcttccctggctcctctctgcatccttcccgaccttcccagcaatatgcatcttgcacgtctggtcggctcctgctccctccttctgctactgggggccctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggccgggaaggaagcagacaaagcggtccaagggttccacactggggtccaccaggctgggaaggaagcagagaaacttggccaaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcagtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacacca

SEQ ID NO: 604 - protein, 247 aa, Homo Sapien
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 605 - DNA, 1098 bp, Homo Sapien
gcgacgcgcggcggggcggcgagaggaaacgcggcgccgggccgggcccggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttgcaaaaaaaaaaaaaaaaaaaaaaaaaa

SEQ ID NO: 606 - protein, 188 aa, Homo Sapien
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFW

SEQ ID NO: 607 - DNA, 2265 bp, Homo Sapien
gcatttgccactggttgcagatcaggcggacgaggagccgggaaggcagagccatgtggctgccccctgctctgctccttctcagcctctcaggctgtttctccatccaaggcccagagtctgtgagagccccagagcaggggtccctgacggttcaatgccactataagcaaggatgggagacctacattaagtggtggtgccgaggggtgcgctgggatacatgcaagatcctcattgaaaccagagggtcggagcaaggagagaagagtgaccgtgtgtccatcaaggacaatcagaaagaccgcacgttcactgtgaccatggaggggctcaggcgagatgacgcagatgtttactggtgtgggattgaaagaagaggacctgaccttgggactcaagtgaaagtgatcgttgacccagagggagcggcttccacaacagcaagctcacctaccaacagcaatatggcagtgttcatcggctcccacaagaggaaccactacatgctcctggtatttgtgaaggtgcccatcttgctcatcttggtcactgccatcctctggttgaaggggtctcagagggtccctgaggagccaggggaacagcctatctacatgaacttctccgaacctctgactaaagacatggccacttagagagatggatctgcagagccttcctgccctggccacgtttccagaagagactcgggctgtggaaggaacatctacgagtcctcgggatgcagtgactgagataggggccctgggcctccgccctggccttggagctggtgggcacctccctgttctgcacagctcagggacttagccaggtcctctcctgagccaccatcacctcctggggtgccagcacctgttctcttggtcaggagctgtagagatggagctcaagcactggacgactctgtccccactgctggaataactcgggcacagagcatgggaccaaagtacagaaagaggttgggggagacccccccagccctagacttccatcattccggagaccaactcaacaccgtctttgcctgagaacctgatatatccgtgtttttaaatttttttttttctagcaaagttgggttttaatgacttatgttcataggaaacctctctgatcccacacacaaggagggtgattctgggatgagttcctggttctagggcatgaggggctggatggaccctgtccccagggaggacatggctctgagtccacagggctgaggaggcaatgggaacctccctggcccggcccggtgcttgtcctccccctcccacctcttcctcctcctagctccccaagctccctgcctattcccccacctccgaggggctgcagcttgggagcctcctcagcatgacagcttgggtctcctccccaaaagagcctgtcaggcctcaagaaccacctccaggtggggagggcagtaacgaaaaccatcgcaggaaatggcaccctcccttttcggtgatgttgaaatcatgttactaatgaaaactgtcctagggaagtggttctgtctcctcacaggcttcacccacggcgatgaggcccttgaatgtggtcactttgtgctgtatggttgagggaccctcacaccaaagggaccttcccatgtgagatgtgctcccgcccccacctgcccacaagcaaacacaccacacatgttcggcatgttgccctttgaacacccatgaggacgcctccaacctgctcttggttctaatagggagtactgactgtcagcagtggataaaggagaggggaccctctggtccctagcatggcacccagagcctcccctcttcttgtccttcagccaaagagaaactttctctgactttgaactgaatttaggtctctggccaatgatgggcctgaaaattccataatggccagagaggagagttcgagcccggctaagatcccctgagtcattctgtgagggaccaagacccacagtccaccagccccagggccctacctcctggaatgctttcctggatccagcttcccgaagatccgaccagacccagggaggacggcaccgctccgcgggagggaaagccaaagcatggtgcttcaccagctggactcaggggcgaggggacatgggcgcttgtcaacgtgatgtcattcttttcccaccgtttcttcctgttgatattcaatgaatccgtcaatctctctgggaaaaaaaaaaaaaaaaaaaaaaaaaaaaaaaaaaaaaaaaaa

SEQ ID NO: 608 - protein, 201 aa, Homo Sapien
MWLPPALLLLSLSGCFSIQGPESVRAPEQGSLTVQCHYKQGWETYIKWWCRGVRWDTCKILIETRGSEQGEKSDRVSIKDNQKDRTFTVTMEGLRRDDADVYWCGIERRGPDLGTQVKVIVDPEGAASTTASSPTNSNMAVFIGSHKRNHYMLLVFVKVPILLILVTAILWLKGSQRVPEEPGEQPIYMNFSEPLTKDMAT

SEQ ID NO: 609 - DNA, 1571 bp, Homo Sapien
gatggcgcagccacagcttctgtgagattcgatttctccccagttcccctgtgggtctgaggggaccagaagggtgagctacgttggctttctggaaggggaggctatatgcgtcaattccccaaaacaagttttgacatttcccctgaaatgtcattctctatctattcactgcaagtgcctgctgttccaggccttacctgctgggcactaacggcggagccaggatggggacagaataaaggagccacgacctgtgccaccaactcgcactcagactctgaactcagacctgaaatcttctcttcacgggaggcttggcagtttttcttactcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctctcatgcccacatgacatgccattgtggggaggaagcaatgaagaaatacagccagattctgagtcactttgaaaagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctatttaatgtatttatttttttacttggacatgaaactttaaaaaaattcacagattatatttataacctgactagagcaggtgatgtatttttatacagtaaaaaaaaaaaaccttgtaaattctagaagagtggctaggggggttattcatttgtattcaactaaggacatatttactcatgctgatgctctgtgagatatttgaaattgaaccaatgactacttaggatgggttgtggaataagttttgatgtggaattgcacatctaccttacaattactgaccatccccagtagactccccagtcccataattgtgtatcttccagccaggaatcctacacggccagcatgtatttctacaaataaagttttctttgcataccaaaaaaaaaaaaaaaaaaa

SEQ ID NO: 610 - protein, 261 aa, Homo Sapien
MRQFPKTSFDISPEMSFSIYSLQVPAVPGLTCWALTAEPGWGQNKGATTCATNSHSDSELRPEIFSSREAWQFFLLLWSPDFRPKMKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLSHAHMTCHCGEEAMKKYSQILSHFEKLEPQAAVVKALGELDILLQWMEETE

SEQ ID NO: 611 - DNA, 43 bp, Artificial Sequence
  Synthetic oligonucleotide probe.
tgtaaaacgacggccagttaaatagacctgcaattattaatct

SEQ ID NO: 612 - DNA, 41 bp, Artificial Sequence
  Synthetic oligonucleotide probe.
caggaaacagctatgaccacctgcacacctgcaaatccatt

What is claimed is:

1. An isolated polypeptide comprising:

(a) the amino acid sequence of the polypeptide of SEQ ID NO:544;

(b) the amino acid sequence of the polypeptide of SEQ ID NO:544, lacking its associated signal peptide; or (c) the amino acid sequence of the polypeptide encoded by the full-length coding sequence of the cDNA deposited under ATCC accession number PTA-947.

2. The isolated polypeptide of claim 1 comprising the amino acid sequence of the polypeptide of SEQ ID NO:544.

3. The isolated polypeptide of claim 1 comprising the amino acid sequence of the polypeptide of SEQ ID NO:544, lacking its associated signal peptide.

4. The isolated polypeptide of claim 1 comprising the amino acid sequence of the polypeptide encoded by the full-length coding sequence of the cDNA deposited under ATCC accession number PTA-947.

5. A chimeric polypeptide comprising a polypeptide according to claim 1 fused to a heterologous polypeptide.

6. The chimeric polypeptide of claim 5, wherein said heterologous polypeptide is an epitope tag or an Fc region of an immunoglobulin.

* * * * *